(12) United States Patent
Liu et al.

(10) Patent No.: US 9,322,006 B2
(45) Date of Patent: Apr. 26, 2016

(54) EVALUATION AND IMPROVEMENT OF NUCLEASE CLEAVAGE SPECIFICITY

(71) Applicant: President and Fellows of Harvard College, Cambridge, MA (US)

(72) Inventors: David R. Liu, Lexington, MA (US); John Paul Guilinger, Ridgway, CO (US); Vikram Pattanayak, Cambridge, MA (US)

(73) Assignee: President and Fellows of Harvard College, Cambridge, MA (US)

( * ) Notice: Subject to any disclaimer, the term of this patent is extended or adjusted under 35 U.S.C. 154(b) by 0 days.

(21) Appl. No.: 14/320,271

(22) Filed: Jun. 30, 2014

(65) Prior Publication Data
US 2015/0010526 A1    Jan. 8, 2015

Related U.S. Application Data

(63) Continuation of application No. 14/234,031, filed as application No. PCT/US2012/047778 on Jul. 22, 2012.

(60) Provisional application No. 61/510,841, filed on Jul. 22, 2011.

(51) Int. Cl.
*C12P 19/34* (2006.01)
*C12Q 1/68* (2006.01)
(Continued)

(52) U.S. Cl.
CPC .. *C12N 9/22* (2013.01); *C12Q 1/44* (2013.01); *C12Q 1/6802* (2013.01); *C12Q 1/6874* (2013.01)

(58) Field of Classification Search
USPC ......... 435/6.1, 6.11, 6.12, 91.1, 91.2; 436/94, 436/501; 536/23.1, 24.3, 24.33, 25.3
See application file for complete search history.

(56) References Cited

U.S. PATENT DOCUMENTS 5,780,053 A    7/1998  Ashley et al.
6,057,153 A    5/2000  George et al.
(Continued)

FOREIGN PATENT DOCUMENTS

AU    2012244264       11/2012
CN    103233028 A      8/2013
(Continued)

OTHER PUBLICATIONS

Pattanayak et al., Determining the Specificities of TALENs, Cas9, and Other Genome-Editing Enzymes. Enzymology, 546, 47-78, 2014.*
(Continued)

*Primary Examiner* — Frank Lu
(74) *Attorney, Agent, or Firm* — Wolf, Greenfield & Sacks, P.C.

(57) ABSTRACT

Engineered nucleases are promising tools for genome manipulation and determining off-target cleavage sites of these enzymes is of great interest. We developed an in vitro selection method that interrogates $10^{11}$ DNA sequences for their ability to be cleaved by nucleases. The method revealed hundreds of thousands of DNA sequences that can be cleaved in vitro by two ZFNs, CCR5-224 and VF2468, which target the endogenous human CCR5 and VEGF-A genes, respectively. Analysis of the identified sites in cultured human cells revealed CCR5-224-induced mutagenesis at nine off-target loci. Similarly, we observed 31 off-target sites cleaved by VF2468 in cultured human cells. Our findings establish an energy compensation model of ZFN specificity in which excess binding energy contributes to off-target ZFN cleavage and suggest strategies for the improvement of future nuclease design. It was also observed that TALENs can achieve cleavage specificity similar to or higher than that observed in ZFNs.

26 Claims, 67 Drawing Sheets

(51) Int. Cl.
*C07H 21/02* (2006.01)
*C07H 21/04* (2006.01)
*C07H 21/00* (2006.01)
*C12N 9/22* (2006.01)
*C12Q 1/44* (2006.01)

(56) References Cited

U.S. PATENT DOCUMENTS

| | | |
|---|---|---|
| 6,453,242 B1 | 9/2002 | Eisenberg et al. |
| 6,503,717 B2 | 1/2003 | Case et al. |
| 6,534,261 B1 | 3/2003 | Cox, III et al. |
| 6,599,692 B1 | 7/2003 | Case et al. |
| 6,607,882 B1 | 8/2003 | Cox, III et al. |
| 6,824,978 B1 | 11/2004 | Cox, III et al. |
| 6,933,113 B2 | 8/2005 | Case et al. |
| 6,979,539 B2 | 12/2005 | Cox, III et al. |
| 7,013,219 B2 | 3/2006 | Case et al. |
| 7,163,824 B2 | 1/2007 | Cox, III et al. |
| 7,479,573 B2 | 1/2009 | Chu et al. |
| 7,794,931 B2 | 9/2010 | Breaker et al. |
| 7,919,277 B2 | 4/2011 | Russell et al. |
| 8,361,725 B2 | 1/2013 | Russell et al. |
| 8,546,553 B2 | 10/2013 | Terns et al. |
| 8,569,256 B2 | 10/2013 | Heyes et al. |
| 8,680,069 B2 | 3/2014 | de Fougerolles et al. |
| 8,691,750 B2 | 4/2014 | Constien et al. |
| 8,697,359 B1 | 4/2014 | Zhang |
| 8,709,466 B2 | 4/2014 | Coady et al. |
| 8,728,526 B2 | 5/2014 | Heller |
| 8,748,667 B2 | 6/2014 | Budzik et al. |
| 8,758,810 B2 | 6/2014 | Okada et al. |
| 8,759,103 B2 | 6/2014 | Kim et al. |
| 8,759,104 B2 | 6/2014 | Unciti-Broceta et al. |
| 8,771,728 B2 | 7/2014 | Huang et al. |
| 8,790,664 B2 | 7/2014 | Pitard et al. |
| 8,846,578 B2 | 9/2014 | McCray et al. |
| 2006/0088864 A1 | 4/2006 | Smolke et al. |
| 2008/0124725 A1 | 5/2008 | Barrangou et al. |
| 2008/0182254 A1 | 7/2008 | Hall et al. |
| 2009/0130718 A1 | 5/2009 | Short |
| 2009/0234109 A1 | 9/2009 | Han et al. |
| 2010/0076057 A1 | 3/2010 | Sontheimer et al. |
| 2010/0093617 A1 | 4/2010 | Barrangou et al. |
| 2010/0104690 A1 | 4/2010 | Barrangou et al. |
| 2011/0104787 A1 | 5/2011 | Church et al. |
| 2011/0189776 A1 | 8/2011 | Terns et al. |
| 2011/0217739 A1 | 9/2011 | Terns et al. |
| 2012/0141523 A1 | 6/2012 | Castado et al. |
| 2012/0270273 A1 | 10/2012 | Zhang et al. |
| 2013/0130248 A1 | 5/2013 | Haurwitz et al. |
| 2013/0158245 A1 | 6/2013 | Russell et al. |
| 2013/0344117 A1 | 12/2013 | Mirosevich et al. |
| 2014/0005269 A1 | 1/2014 | Ngwuluka et al. |
| 2014/0017214 A1 | 1/2014 | Cost |
| 2014/0018404 A1 | 1/2014 | Chen et al. |
| 2014/0044793 A1 | 2/2014 | Goll et al. |
| 2014/0068797 A1 | 3/2014 | Doudna et al. |
| 2014/0127752 A1 | 5/2014 | Zhou et al. |
| 2014/0141094 A1 | 5/2014 | Smyth et al. |
| 2014/0141487 A1 | 5/2014 | Feldman et al. |
| 2014/0186843 A1 | 7/2014 | Zhang et al. |
| 2014/0186958 A1 | 7/2014 | Zhang et al. |
| 2014/0234289 A1 | 8/2014 | Liu et al. |
| 2014/0273037 A1 | 9/2014 | Wu |
| 2014/0273226 A1 | 9/2014 | Wu |
| 2014/0273230 A1 | 9/2014 | Chen et al. |
| 2014/0295556 A1 | 10/2014 | Joung et al. |
| 2014/0295557 A1 | 10/2014 | Joung et al. |
| 2014/0342456 A1 | 11/2014 | Mali et al. |
| 2014/0342457 A1 | 11/2014 | Mali et al. |
| 2014/0342458 A1 | 11/2014 | Mali et al. |
| 2014/0349400 A1 | 11/2014 | Jakimo et al. |
| 2014/0356867 A1 | 12/2014 | Peter et al. |
| 2014/0356956 A1 | 12/2014 | Church et al. |
| 2014/0356958 A1 | 12/2014 | Mali et al. |
| 2014/0356959 A1 | 12/2014 | Church et al. |
| 2014/0357523 A1 | 12/2014 | Zeiner et al. |
| 2014/0377868 A1 | 12/2014 | Joung et al. |
| 2015/0031089 A1 | 1/2015 | Lindstrom |
| 2015/0031132 A1 | 1/2015 | Church et al. |
| 2015/0031133 A1 | 1/2015 | Church et al. |
| 2015/0044191 A1 | 2/2015 | Liu et al. |
| 2015/0044192 A1 | 2/2015 | Liu et al. |
| 2015/0050699 A1 | 2/2015 | Siksnys et al. |
| 2015/0056177 A1 | 2/2015 | Liu et al. |
| 2015/0056629 A1 | 2/2015 | Guthrie-Honea |
| 2015/0064138 A1 | 3/2015 | Lu et al. |
| 2015/0071898 A1 | 3/2015 | Liu et al. |
| 2015/0071899 A1 | 3/2015 | Liu et al. |
| 2015/0071900 A1 | 3/2015 | Liu et al. |
| 2015/0071901 A1 | 3/2015 | Liu et al. |
| 2015/0071902 A1 | 3/2015 | Liu et al. |
| 2015/0071903 A1 | 3/2015 | Liu et al. |
| 2015/0071906 A1 | 3/2015 | Liu et al. |
| 2015/0079680 A1 | 3/2015 | Bradley et al. |
| 2015/0098954 A1 | 4/2015 | Hyde et al. |
| 2015/0118216 A1 | 4/2015 | Liu et al. |
| 2015/0132269 A1 | 5/2015 | Orkin et al. |
| 2015/0140664 A1 | 5/2015 | Byrne et al. |

FOREIGN PATENT DOCUMENTS

| | | |
|---|---|---|
| CN | 103388006 A | 11/2013 |
| CN | 103614415 A | 3/2014 |
| CN | 103642836 A | 3/2014 |
| CN | 103668472 A | 3/2014 |
| CN | 103820441 A | 5/2014 |
| CN | 103820454 A | 5/2014 |
| CN | 103911376 A | 7/2014 |
| CN | 103923911 A | 7/2014 |
| CN | 104004778 A | 8/2014 |
| CN | 104109687 A | 10/2014 |
| CN | 104178461 A | 12/2014 |
| CN | 104342457 | 2/2015 |
| CN | 104404036 A | 3/2015 |
| CN | 104450774 A | 3/2015 |
| CN | 104480144 A | 4/2015 |
| CN | 104498493 A | 4/2015 |
| CN | 104504304 A | 4/2015 |
| CN | 104531704 A | 4/2015 |
| CN | 104531705 A | 4/2015 |
| CN | 104560864 A | 4/2015 |
| CN | 104593418 A | 5/2015 |
| CN | 104593422 A | 5/2015 |
| CN | 104611370 A | 5/2015 |
| WO | WO 2006/002547 A1 | 1/2006 |
| WO | WO 2006/042112 A2 | 4/2006 |
| WO | WO 2007/025097 A2 | 3/2007 |
| WO | WO 2007/136815 A2 | 11/2007 |
| WO | WO 2010/054108 A2 | 5/2010 |
| WO | WO 2010/054154 A2 | 5/2010 |
| WO | WO 2010/075424 A2 | 7/2010 |
| WO | WO 2011/017293 A2 | 2/2011 |
| WO | WO 2011/053982 A2 | 5/2011 |
| WO | WO 2012/054726 A1 | 4/2012 |
| WO | WO 2012/138927 A2 | 10/2012 |
| WO | WO 2012/158985 A2 | 11/2012 |
| WO | WO 2012/158986 A2 | 11/2012 |
| WO | WO 2012/164565 A1 | 12/2012 |
| WO | WO 2013/012674 A1 | 1/2013 |
| WO | WO 2013/013105 A2 | 1/2013 |
| WO | WO 2013/066438 A2 | 5/2013 |
| WO | WO 2013/098244 A1 | 7/2013 |
| WO | WO 2013/126794 A1 | 8/2013 |
| WO | WO 2013/130824 A1 | 9/2013 |
| WO | WO 2013/141680 A1 | 9/2013 |
| WO | WO 2013/142378 A9 | 9/2013 |
| WO | WO 2013/142578 A2 | 9/2013 |
| WO | WO 2013/166315 A1 | 11/2013 |
| WO | WO 2013/169398 A2 | 11/2013 |
| WO | WO 2013/169802 A1 | 11/2013 |
| WO | WO 2013/176772 A2 | 11/2013 |
| WO | WO 2013/176915 A1 | 11/2013 |
| WO | WO 2013/176916 A1 | 11/2013 |

(56) References Cited

FOREIGN PATENT DOCUMENTS

| | | |
|---|---|---|
| WO | WO 2013/181440 A1 | 12/2013 |
| WO | WO 2013/186754 A2 | 12/2013 |
| WO | WO 2013/188037 A2 | 12/2013 |
| WO | WO 2013/188522 A2 | 12/2013 |
| WO | WO 2013/188638 A2 | 12/2013 |
| WO | WO 2014/005042 A2 | 1/2014 |
| WO | WO 2014/011237 A1 | 1/2014 |
| WO | WO 2014/011901 A2 | 1/2014 |
| WO | WO 2014/018423 A2 | 1/2014 |
| WO | WO 2014/022120 A1 | 2/2014 |
| WO | WO 2014/022702 A2 | 2/2014 |
| WO | WO 2014/036219 A2 | 3/2014 |
| WO | WO 2014/039513 A2 | 3/2014 |
| WO | WO 2014/039523 A1 | 3/2014 |
| WO | WO 2014/039684 A1 | 3/2014 |
| WO | WO 2014/039692 A2 | 3/2014 |
| WO | WO 2014/039702 A2 | 3/2014 |
| WO | WO 2014/039872 A1 | 3/2014 |
| WO | WO 2014/039970 A1 | 3/2014 |
| WO | WO 2014/041327 A1 | 3/2014 |
| WO | WO 2014/043143 A1 | 3/2014 |
| WO | WO 2014/047103 A2 | 3/2014 |
| WO | WO 2014/059173 A2 | 4/2014 |
| WO | WO 2014/059255 A1 | 4/2014 |
| WO | WO 2014/065596 A1 | 5/2014 |
| WO | WO 2014/066505 A1 | 5/2014 |
| WO | WO 2014/068346 A2 | 5/2014 |
| WO | WO 2014/070887 A1 | 5/2014 |
| WO | WO 2014/071006 A1 | 5/2014 |
| WO | WO 2014/071219 A1 | 5/2014 |
| WO | WO 2014/071235 A1 | 5/2014 |
| WO | WO 2014/072941 A1 | 5/2014 |
| WO | WO 2014/081729 A1 | 5/2014 |
| WO | WO 2014/081730 A1 | 5/2014 |
| WO | WO 2014/081855 A1 | 5/2014 |
| WO | WO 2014/082644 A1 | 6/2014 |
| WO | WO 2014/085261 A1 | 6/2014 |
| WO | WO 2014/085593 A1 | 6/2014 |
| WO | WO 2014/085830 A2 | 6/2014 |
| WO | WO 2014/089212 A1 | 6/2014 |
| WO | WO 2014/089290 A1 | 6/2014 |
| WO | WO 2014/089348 A1 | 6/2014 |
| WO | WO 2014/089513 A1 | 6/2014 |
| WO | WO 2014/089533 A2 | 6/2014 |
| WO | WO 2014/089541 A2 | 6/2014 |
| WO | WO 2014/093479 A1 | 6/2014 |
| WO | WO 2014/093595 A1 | 6/2014 |
| WO | WO 2014/093622 A2 | 6/2014 |
| WO | WO 2014/093635 A1 | 6/2014 |
| WO | WO 2014/093655 A2 | 6/2014 |
| WO | WO 2014/093661 A2 | 6/2014 |
| WO | WO 2014/093694 A1 | 6/2014 |
| WO | WO 2014/093701 A1 | 6/2014 |
| WO | WO 2014/093709 A1 | 6/2014 |
| WO | WO 2014/093712 A1 | 6/2014 |
| WO | WO 2014/093718 A1 | 6/2014 |
| WO | WO 2014/099744 A1 | 6/2014 |
| WO | WO 2014/099750 A2 | 6/2014 |
| WO | WO 2014/113493 A1 | 7/2014 |
| WO | WO 2014/124226 A1 | 8/2014 |
| WO | WO 2014/127287 A1 | 8/2014 |
| WO | WO 2014/128324 A1 | 8/2014 |
| WO | WO 2014/128659 A1 | 8/2014 |
| WO | WO 2014/130955 A1 | 8/2014 |
| WO | WO 2014/131833 A1 | 9/2014 |
| WO | WO 2014/143381 A1 | 9/2014 |
| WO | WO 2014/144094 A1 | 9/2014 |
| WO | WO 2014/144155 A1 | 9/2014 |
| WO | WO 2014/144288 A1 | 9/2014 |
| WO | WO 2014/144592 A2 | 9/2014 |
| WO | WO 2014/144761 A2 | 9/2014 |
| WO | WO 2014/145599 A2 | 9/2014 |
| WO | WO 2014/150624 A1 | 9/2014 |
| WO | WO 2014/152432 A2 | 9/2014 |
| WO | WO 2014/153470 A2 | 9/2014 |
| WO | WO 2014/164466 A1 | 10/2014 |
| WO | WO 2014/165177 A1 | 10/2014 |
| WO | WO 2014/165349 A1 | 10/2014 |
| WO | WO 2014/165825 A2 | 10/2014 |
| WO | WO 2014/172458 A1 | 10/2014 |
| WO | WO 2014/172470 A | 10/2014 |
| WO | WO 2014/182700 A1 | 11/2014 |
| WO | WO 2014/183071 A2 | 11/2014 |
| WO | WO 2014/184143 A1 | 11/2014 |
| WO | WO 2014/184741 A1 | 11/2014 |
| WO | WO 2014/184744 A1 | 11/2014 |
| WO | WO 2014/186585 A2 | 11/2014 |
| WO | WO 2014/186686 A2 | 11/2014 |
| WO | WO 2014/190181 A1 | 11/2014 |
| WO | WO 2014/191128 A1 | 12/2014 |
| WO | WO 2014/191518 A1 | 12/2014 |
| WO | WO 2014/191521 A2 | 12/2014 |
| WO | WO 2014/191525 A1 | 12/2014 |
| WO | WO 2014/191527 A1 | 12/2014 |
| WO | WO 2014/194190 A1 | 12/2014 |
| WO | WO 2014/197568 A2 | 12/2014 |
| WO | WO 2014/197748 A2 | 12/2014 |
| WO | WO 2014/200659 A1 | 12/2014 |
| WO | WO 2014/201015 A2 | 12/2014 |
| WO | WO 2014/204578 A1 | 12/2014 |
| WO | WO 2014/204723 A1 | 12/2014 |
| WO | WO 2014/204724 A1 | 12/2014 |
| WO | WO 2014/204725 A1 | 12/2014 |
| WO | WO 2014/204726 A1 | 12/2014 |
| WO | WO 2014/204727 A1 | 12/2014 |
| WO | WO 2014/204728 A1 | 12/2014 |
| WO | WO 2014/204729 A1 | 12/2014 |
| WO | WO 2015/002780 A1 | 1/2015 |
| WO | WO 2015/004241 A2 | 1/2015 |
| WO | WO 2015/006290 A1 | 1/2015 |
| WO | WO 2015/006294 A2 | 1/2015 |
| WO | WO 2015/006498 A2 | 1/2015 |
| WO | WO 2015/006747 A2 | 1/2015 |
| WO | WO 2015/010114 A1 | 1/2015 |
| WO | WO 2015/013583 A2 | 1/2015 |
| WO | WO 2015/017866 A1 | 2/2015 |
| WO | WO 2015/018503 A1 | 2/2015 |
| WO | WO 2015/021353 A1 | 2/2015 |
| WO | WO 2015/021426 A1 | 2/2015 |
| WO | WO 2015/021990 A1 | 2/2015 |
| WO | WO 2015/024017 A2 | 2/2015 |
| WO | WO 2015/026883 A1 | 2/2015 |
| WO | WO 2015/026885 A1 | 2/2015 |
| WO | WO 2015/026886 A1 | 2/2015 |
| WO | WO 2015/026887 A1 | 2/2015 |
| WO | WO 2015/027134 A1 | 2/2015 |
| WO | WO 2015/031619 A1 | 3/2015 |
| WO | WO 2015/031775 A1 | 3/2015 |
| WO | WO 2015/033293 A1 | 3/2015 |
| WO | WO 2015/034872 A2 | 3/2015 |
| WO | WO 2015/035136 A2 | 3/2015 |
| WO | WO 2015/035139 A2 | 3/2015 |
| WO | WO 2015/040075 A1 | 3/2015 |
| WO | WO 2015/040402 A1 | 3/2015 |
| WO | WO 2015/048577 A2 | 4/2015 |
| WO | WO 2015/048690 A1 | 4/2015 |
| WO | WO 2015/052133 A1 | 4/2015 |
| WO | WO 2015/052231 A2 | 4/2015 |
| WO | WO 2015/053995 A1 | 4/2015 |
| WO | WO 2015/054253 A1 | 4/2015 |
| WO | WO 2015/057976 A1 | 4/2015 |
| WO | WO 2015/057980 A1 | 4/2015 |
| WO | WO 2015/059265 A1 | 4/2015 |
| WO | WO 2015/065964 A1 | 5/2015 |
| WO | WO 2015/066119 A1 | 5/2015 |
| WO | WO 2015/066637 A1 | 5/2015 |
| WO | WO 2015/070083 A1 | 5/2015 |
| WO | WO 2015/070193 A1 | 5/2015 |
| WO | WO 2015/070212 A1 | 5/2015 |
| WO | WO 2015/071474 A2 | 5/2015 |
| WO | WO 2015/073683 A2 | 5/2015 |

(56) References Cited

FOREIGN PATENT DOCUMENTS

WO    WO 2015/073867 A1    5/2015
WO    WO 2015/073990 A1    5/2015

OTHER PUBLICATIONS

International Search Report and Written Opinion for PCT/US2014/050283, mailed Nov. 6, 2014.
GENBANK Submission; NIH/NCBI, Accession No. J04623. Kita et al., Apr. 26, 1993. 2 pages.
Barrangou, RNA-mediated programmable DNA cleavage. Nat Biotechnol. Sep. 2012;30(9):836-8. doi: 10.1038/nbt.2357.
Carroll, A CRISPR approach to gene targeting. Mol Ther. Sep. 2012;20(9):1658-60. doi: 10.1038/mt.2012.171.
Fuchs et al., Polyarginine as a multifunctional fusion tag. Protein Sci. Jun. 2005;14(6):1538-44.
O'Connell et al., Programmable RNA recognition and cleavage by CRISPR/Cas9. Nature. Sep. 28, 2014. doi: 10.1038/nature13769.
Zhang et al., CRISPR/Cas9 for genome editing: progress, implications and challenges. Hum Mol Genet. Sep. 15, 2014;23(R1):R40-6. doi: 10.1093/hmg/ddu125. Epub Mar. 20, 2014.
U.S. Appl. No. 61/716,256, filed Oct. 19, 2012, Jinek et al.
U.S. Appl. No. 61/717,324, filed Oct. 23, 2012, Cho et al.
U.S. Appl. No. 61/734,256, filed Dec. 6, 2012, Chen et al.
U.S. Appl. No. 61/758,624, filed Jan. 30, 2013, Chen et al.
U.S. Appl. No. 61/761,046, filed Feb. 5, 2013, Knight et al.
U.S. Appl. No. 61/794,422, filed Mar. 15, 2013, Knight et al.
U.S. Appl. No. 61/803,599, filed Mar. 20, 2013, Kim et al.
U.S. Appl. No. 61/837,481, filed Jun. 20, 2013, Cho et al.
U.S. Appl. No. 14/258,458, filed Apr. 22, 2014, Cong.
International Search Report and Written Opinion for PCT/US2012/047778, mailed May 30, 2013.
International Preliminary Report on Patentability for PCT/US2012/047778, mailed Feb. 6, 2014.
International Search Report for PCT/US2013/032589, mailed Jul. 26, 2013.
GENBANK Submission; NIH/NCBI, Accession No. J04623. Kita et al., Aug. 26, 1993. 2 pages.
GENBANK Submission; NIH/NCBI, Accession No. NC_002737.1. Ferretti et al., Jun. 27, 2013. 1 page.
GENBANK Submission; NIH/NCBI, Accession No. NC_015683.1. Trost et al., Jul. 6, 2013. 1 page.
GENBANK Submission; NIH/NCBI, Accession No. NC_016782.1. Trost et al., Jun. 11, 2013. 1 page.
GENBANK Submission; NIH/NCBI, Accession No. NC_016786.1. Trost et al., Aug. 28, 2013. 1 page.
GENBANK Submission; NIH/NCBI, Accession No. NC_017053.1. Fittipaldi et al., Jul. 6, 2013. 1 page.
GENBANK Submission; NIH/NCBI, Accession No. NC_017317.1. Trost et al., Jun. 11, 2013. 1 page.
GENBANK Submission; NIH/NCBI, Accession No. NC_017861.1. Heidelberg et al., Jun. 11, 2013. 1 page.
GENBANK Submission; NIH/NCBI, Accession No. NC_018010.1. Lucas et al., Jun. 11, 2013. 2 pages.
GENBANK Submission; NIH/NCBI, Accession No. NC_018721.1. Feng et al., Jun. 11, 2013. 1 pages.
GENBANK Submission; NIH/NCBI, Accession No. NC_021284.1. Ku et al., Jul. 12, 2013. 1 page.
GENBANK Submission; NIH/NCBI, Accession No. NC_021314.1. Zhang et al., Jul. 15, 2013. 1 page.
GENBANK Submission; NIH/NCBI, Accession No. NC_021846.1. Lo et al., Jul. 22, 2013. 1 page.
GENBANK Submission; NIH/NCBI, Accession No. NP_472073.1. Glaser et al., Jun. 27, 2013. 2 pages.
GENBANK Submission; NIH/NCBI, Accession No. P42212. Prasher et al., Mar. 19, 2014. 7 pages.
GENBANK Submission; NIH/NCBI, Accession No. YP_002342100.1. Bernardini et al., Jun. 10, 2013. 2 pages.
GENBANK Submission; NIH/NCBI, Accession No. YP_002344900.1. Gundogdu et al., Mar. 19, 2014. 2 pages.
GENBANK Submission; NIH/NCBI, Accession No. YP_820832.1. Makarova et al., Aug. 27, 2013. 2 pages.
UNIPROT Submission; UniProt, Accession No. P04275. Last modified Jul. 9, 2014, version 107. 29 pages.
UNIPROT Submission; UniProt, Accession No. P04264. Last modified Jun. 11, 2014, version 6. 15 pages.
UNIPROT Submission; UniProt, Accession No. P01011. Last modified Jun. 11, 2014, version 2. 15 pages.
Barrangou et al., CRISPR provides acquired resistance against viruses in prokaryotes. Science. Mar. 23, 2007;315(5819):1709-12.
Bedell et al., In vivo genome editing using a high-efficiency TALEN system. Nature. Nov. 1, 2012;491(7422):114-8. Doi: 10.1038/nature11537. Epub Sep. 23, 2012.
Beumer et al., Efficient gene targeting in *Drosophila* with zinc-finger nucleases. Genetics. Apr. 2006;172(4):2391-403. Epub Feb. 1, 2006.
Bibikova et al., Stimulation of homologous recombination through targeted cleavage by chimeric nucleases. Mol Cell Biol. Jan. 2001;21(1):289-97.
Bibikova et al., Targeted chromosomal cleavage and mutagenesis in *Drosophila* using zinc-finger nucleases. Genetics. Jul. 2002;161(3):1169-75.
Boch et al., Breaking the code of DNA binding specificity of TAL-type III effectors. Science. Dec. 11, 2009;326(5959):1509-12. Doi: 10.1126/science.1178811.
Boch, TALEs of genome targeting. Nat Biotechnol. Feb. 2011;29(2):135-6. Doi: 10.1038/nbt.1767.
Bulyk et al., Exploring the DNA-binding specificities of zinc fingers with DNA microarrays. Proc Natl Acad Sci U S A. Jun. 19, 2001;98(13):7158-63. Epub Jun. 12, 2001.
Cade et al., Highly efficient generation of heritable zebrafish gene mutations using homo- and heterodimeric TALENs. Nucleic Acids Res. Sep. 2012;40(16):8001-10. Doi: 10.1093/nar/gks518. Epub Jun. 7, 2012.
Carroll et al., Gene targeting in *Drosophila* and *Caenorhabditis elegans* with zinc-finger nucleases. Methods Mol Biol. 2008;435:63-77. doi: 10.1007/978-1-59745-232-8_5.
Carroll et al., Progress and prospects: zinc-finger nucleases as gene therapy agents. Gene Ther. Nov. 2008;15(22):1463-8. doi: 10.1038/gt.2008.145. Epub Sep. 11, 2008.
Cermak et al., Efficient design and assembly of custom TALEN and other TAL effector-based constructs for DNA targeting. Nucleic Acids Res. Jul. 2011;39(12):e82. Doi: 10.1093/nar/gkr218. Epub Apr. 14, 2011.
Charpentier et al., Biotechnology: Rewriting a genome. Nature. Mar. 7, 2013;495(7439):50-1. doi: 10.1038/495050a.
Cho et al., Analysis of off-target effects of CRISPR/Cas-derived RNA-guided endonucleases and nickases. Genome Res. Jan. 2014;24(1):132-41. doi: 10.1101/gr.162339.113. Epub Nov. 19, 2013.
Christian et al, Targeting G with TAL effectors: a comparison of activities of TALENs constructed with NN and NK repeat variable di-residues. PLoS One. 2012;7(9):e45383. doi: 10.1371/journal.pone.0045383. Epub Sep. 24, 2012.
Christian et al., Targeting DNA double-strand breaks with TAL effector nucleases. Genetics. Oct. 2012;186(2):757-61. Doi: 10.1534/genetics.110.120717. Epub Jul. 26, 2010.
Chylinski et al., The tracrRNA and Cas9 families of type II CRISPR-Cas immunity systems. RNA Biol. May 2013;10(5):726-37. doi: 10.4161/rna.24321. Epub Apr. 5, 2013.
Cobb et al., Directed evolution as a powerful synthetic biology tool. Methods. Mar. 15, 2013;60(1):81-90. doi: 10.1016/j.ymeth.2012.03.009. Epub Mar. 23, 2012.
Cobb et al., Directed evolution: an evolving and enabling synthetic biology tool. Curr Opin Chem Biol. Aug. 2012;16(3-4):285-91. doi:10.1016/j.cbpa.2012.05.186. Epub Jun. 4, 2012. Review.
Cong et al., Comprehensive interrogation of natural TALE DNA-binding modules and transcriptional repressor domains. Nat Commun. Jul. 24, 2012;3:968. doi: 10.1038/ncomms1962.
Cong et al., Multiplex genome engineering using CRISPR/Cas systems. Science. Feb. 15, 2013;339(6121):819-23. doi: 10.1126/science.1231143. Epub Jan. 3, 2013.

(56) References Cited

OTHER PUBLICATIONS

Cornu et al., DNA-binding specificity is a major determinant of the activity and toxicity of zinc-finger nucleases. Mol Ther. Feb. 2008;16(2):352-8. Epub Nov. 20, 2007.

Cradick et al., CRISPR/Cas9 systems targeting β-globin and CCR5 genes have substantial off-target activity. Nucleic Acids Res. Nov. 1, 2013;41(20):9584-92. doi: 10.1093/nar/gkt714. Epub Aug. 11, 2013.

Cradick et al., Zinc-finger nucleases as a novel therapeutic strategy for targeting hepatitis B virus DNAs. Mol Ther. May 2010;18(5):947-54. Doi: 10.1038/mt.2010.20. Epub Feb. 16, 2010.

Cui et al., Targeted integration in rat and mouse embryos with zinc-finger nucleases. Nat Biotechnol. Jan. 2011;29(1):64-7. Doi: 10.1038/nbt.1731. Epub Dec. 12, 2010.

Dahlem et al., Simple methods for generating and detecting locus-specific mutations induced with TALENs in the zebrafish genome. PLoS Genet. 2012;8(8):e1002861. doi: 10.1371/journal.pgen. 1002861. Epub Aug. 16, 2012.

De Souza, Primer: genome editing with engineered nucleases. Nat Methods. Jan. 2012;9(1):27.

Deltcheva et al., CRISPR RNA maturation by trans-encoded small RNA and host factor RNase III. Nature. Mar. 31, 2011;471(7340):602-7. doi: 10.1038/nature09886.

Dicarlo et al., Genome engineering in Saccharomyces cerevisiae using CRISPR-Cas systems. Nucleic Acids Res. Apr. 2013;41(7):4336-43. doi: 10.1093/nar/gkt135. Epub Mar. 4, 2013.

Ding et al., A TALEN genome-editing system for generating human stem cell-based disease models. Cell Stem Cell. Feb. 7, 2013;12(2):238-51. Doi: 10.1016/j.stem.2012.11.011. Epub Dec. 13, 2012.

Doyon et al., Enhancing zinc-finger-nuclease activity with improved obligate heterodimeric architectures. Nat Methods. Jan. 2011;8(1):74-9. Doi: 10.1038/nmeth.1539. Epub Dec. 5, 2010.

Doyon et al., Heritable targeted gene disruption in zebrafish using designed zinc-finger nucleases. Nat Biotechnol. Jun. 2008;26(6):702-8. Doi: 10.1038/nbt1409. Epub May 25, 2008.

Esvelt et al., A system for the continuous directed evolution of biomolecules. Nature. Apr. 28, 2011;472(7344):499-503. doi: 10.1038/nature09929. Epub Apr. 10, 2011.

Esvelt et al., Genome-scale engineering for systems and synthetic biology. Mol Syst Biol. 2013;9:641. doi: 10.1038/msb.2012.66.

Esvelt et al., Orthogonal Cas9 proteins for RNA-guided gene regulation and editing. Nat Methods. Nov. 2013;10(11):1116-21. doi: 10.1038/nmeth.2681. Epub Sep. 29, 2013.

Fu et al., Improving CRISPR-Cas nuclease specificity using truncated guide RNAs. Nat Biotechnol. Mar. 2014;32(3):279-84. doi: 10.1038/nbt.2808. Epub Jan. 26, 2014.

Fu et al., High-frequency off-target mutagenesis induced by CRISPR-Cas nucleases in human cells. Nat Biotechnol. Sep. 2013;31(9):822-6. doi: 10.1038/nbt.2623. Epub Jun. 23, 2013.

Gabriel et al., An unbiased genome-wide analysis of zinc-finger nuclease specificity. Nat Biotechnol. Aug. 7, 2011;29(9):816-23. doi: 10.1038/nbt.1948.

Gaj et al., Structure-guided reprogramming of serine recombinase DNA sequence specificity. Proc Natl Acad Sci U S A. Jan. 11, 2011;108(2):498-503. doi: 10.1073/pnas.1014214108. Epub Dec. 27, 2010.

Gaj et al., ZFN, TALEN, and CRISPR/Cas-based methods for genome engineering. Trends Biotechnol. Jul. 2013;31(7):397-405. doi: 10.1016/j.tibtech.2013.04.004. Epub May 9, 2013.

Gao et al., Crystal structure of a TALE protein reveals an extended N-terminal DNA binding region. Cell Res. Dec. 2012;22(12):1716-20. doi: 10.1038/cr.2012.156. Epub Nov. 13, 2012.

Gasiunas et al., Cas9-crRNA ribonucleoprotein complex mediates specific DNA cleavage for adaptive immunity in bacteria. Proc Natl Acad Sci U S A. Sep. 25, 2012;109(39):E2579-86. Epub Sep. 4, 2012. Supplementary materials included.

Gasiunas et al., RNA-dependent DNA endonuclease Cas9 of the CRISPR system: Holy Grail of genome editing? Trends Microbiol. Nov. 2013;21(11):562-7. doi: 10.1016/j.tim.2013.09.001. Epub Oct. 1, 2013.

Gilbert et al., CRISPR-mediated modular RNA-guided regulation of transcription in eukaryotes. Cell. 2013 154(2):442-51.

Gordley et al., Evolution of programmable zinc finger-recombinases with activity in human cells. J Mol Biol. Mar. 30, 2007;367(3):802-13. Epub Jan. 12, 2007.

Guilinger et al., Broad specificity profiling of TALENs results in engineered nucleases with improved DNA-cleavage specificity. Nat Methods. Apr. 2014;11(4):429-35. doi: 10.1038/nmeth.2845. Epub Feb. 16, 2014.

Guilinger et al., Fusion of catalytically inactive Cas9 to FokI nuclease improves the specificity of genome modification. Nat Biotechnol. Jun. 2014;32(6):577-82. doi: 10.1038/nbt.2909. Epub Apr. 25, 2014.

Guo et al., Directed evolution of an enhanced and highly efficient FokI cleavage domain for zinc finger nucleases. J Mol Biol. Jul. 2, 2010;400(1):96-107. doi: 10.1016/j.jmb.2010.04.060. Epub May 4, 2010.

Gupta et al., Zinc finger protein-dependent and -independent contributions to the in vivo off-target activity of zinc finger nucleases. Nucleic Acids Res. Jan. 2011;39(1):381-92. doi: 10.1093/nar/gkq787. Epub Sep. 14, 2010.

Hale et al., RNA-guided RNA cleavage by a CRISPR RNA-Cas protein complex. Cell. Nov. 25, 2009;139(5):945-56. doi: 10.1016/j.cell.2009.07.040.

Händel et al., Expanding or restricting the target site repertoire of zinc-finger nucleases: the inter-domain linker as a major determinant of target site selectivity. Mol Ther. Jan. 2009;17(1):104-11. doi: 10.1038/mt.2008.233. Epub Nov. 11, 2008.

Hartung et al., Cre mutants with altered DNA binding properties. J Biol Chem. Sep. 4, 1998;273(36):22884-91.

Hirano et al., Site-specific recombinases as tools for heterologous gene integration. Appl Microbiol Biotechnol. Oct. 2011;92(2):227-39. doi: 10.1007/s00253-011-3519-5. Epub Aug. 7, 2011. Review.

Hockemeyer et al., Efficient targeting of expressed and silent genes in human ESCs and iPSCs using zinc-finger nucleases. Nat Biotechnol. Sep. 2009;27(9):851-7. doi: 10.1038/nbt.1562. Epub Aug. 13, 2009.

Hockemeyer et al., Genetic engineering of human pluripotent cells using TALE nucleases. Nat Biotechnol. Jul. 7, 2011;29(8):731-4. doi: 10.1038/nbt.1927.

Horvath et al., CRISPR/Cas, the immune system of bacteria and archaea. Science. Jan. 8, 2010;327(5962):167-70. doi: 10.1126/science.1179555.

Hsu et al., DNA targeting specificity of RNA-guided Cas9 nucleases. Nat Biotechnol. Sep. 2013;31(9):827-32. doi: 10.1038/nbt.2647. Epub Jul. 21, 2013.

Huang et al., Heritable gene targeting in zebrafish using customized TALENs. Nat Biotechnol. Aug. 5, 2011;29(8):699-700. doi: 10.1038/nbt.1939.

Humbert et al., Targeted gene therapies: tools, applications, optimization. Crit Rev Biochem Mol Biol. May-Jun. 2012;47(3):264-81. doi: 10.3109/10409238.2012.658112.

Hurt et al., Highly specific zinc finger proteins obtained by directed domain shuffling and cell-based selection. Proc Natl Acad Sci U S A. Oct. 14, 2003;100(21):12271-6. Epub Oct. 3, 2003.

Hwang et al., Efficient genome editing in zebrafish using a CRISPR-Cas system. Nat Biotechnol. Mar. 2013;31(3):227-9. doi: 10.1038/nbt.2501. Epub Jan. 29, 2013.

Jamieson et al., Drug discovery with engineered zinc-finger proteins. Nat Rev Drug Discov. May 2003;2(5):361-8.

Jiang et al., RNA-guided editing of bacterial genomes using CRISPR-Cas systems. Nat Biotechnol. Mar. 2013;31(3):233-9. doi: 10.1038/nbt.2508. Epub Jan. 29, 2013.

Jinek et al., A programmable dual-RNA-guided DNA endonuclease in adaptive bacterial immunity. Science. Aug. 17, 2012;337(6096):816-21. doi: 10.1126/science.1225829. Epub Jun. 28, 2012.

Jinek et al., RNA-programmed genome editing in human cells. Elife. Jan. 29, 2013;2:e00471. doi: 10.7554/eLife.00471.

Jinek et al., Structures of Cas9 endonucleases reveal RNA-mediated conformational activation. Science. Mar. 14, 2014;343(6176):1247997. doi: 10.1126/science.1247997. Epub Feb. 6, 2014.

(56) References Cited

OTHER PUBLICATIONS

Jore et al., Structural basis for CRISPR RNA-guided DNA recognition by Cascade. Nat Struct Mol Biol. May 2011;18(5):529-36. doi: 10.1038/nsmb.2019. Epub Apr. 3, 2011.
Joung et al.,TALENs: a widely applicable technology for targeted genome editing. Nat Rev Mol Cell Biol. Jan. 2013;14(1):49-55. doi: 10.1038/nrm3486. Epub Nov. 21, 2012.
Kaiser et al., Gene therapy. Putting the fingers on gene repair. Science. Dec. 23, 2005;310(5756):1894-6.
Kandavelou et al., Targeted manipulation of mammalian genomes using designed zinc finger nucleases. Biochem Biophys Res Commun. Oct. 9, 2009;388(1):56-61. doi: 10.1016/j.bbrc.2009.07.112. Epub Jul. 25, 2009.
Karpenshif et al., From yeast to mammals: recent advances in genetic control of homologous recombination. DNA Repair (Amst). Oct. 1, 2012;11(10):781-8. doi: 10.1016/j.dnarep.2012.07.001.Epub Aug. 11, 2012. Review.
Kilbride et al., Determinants of product topology in a hybrid Cre-Tn3 resolvase site-specific recombination system. J Mol Biol. Jan. 13, 2006;355(2):185-95. Epub Nov. 9, 2005.
Kim et al., A library of TAL effector nucleases spanning the human genome. Nat Biotechnol. Mar. 2013;31(3):251-8. Doi: 10.1038/nbt.2517. Epub Feb. 17, 2013.
Kim et al., Highly efficient RNA-guided genome editing in human cells via delivery of purified Cas9 ribonucleoproteins. Genome Res. Jun. 2014;24(6):1012-9. doi: 10.1101/gr.171322.113. Epub Apr. 2, 2014.
Kim et al., Hybrid restriction enzymes: zinc finger fusions to Fok I cleavage domain. Proc Natl Acad Sci U S A. Feb. 6, 1996;93(3):1156-60.
Kim et al., TALENs and ZFNs are associated with different mutationsignatures. Nat Methods. Mar. 2013;10(3):185. doi: 10.1038/nmeth.2364. Epub Feb. 10, 2013.
Kim et al., Targeted genome editing in human cells with zinc finger nucleases constructed via modular assembly. Genome Res. Jul. 2009;19(7):1279-88. doi: 10.1101/gr.089417.108. Epub May 21, 2009.
Klug et al., Zinc fingers: a novel protein fold for nucleic acid recognition. Cold Spring Harb Symp Quant Biol. 1987;52:473-82.
Krishna et al., Structural classification of zinc fingers: survey and summary. Nucleic Acids Res. Jan. 15, 2003;31(2):532-50.
Larson et al., CRISPR interference (CRISPRi) for sequence-specific control of gene expression. Nat Protoc. Nov. 2013;8(11):2180-96. doi: 10.1038/nprot.2013.132. Epub Oct. 17, 2013.
Lei et al., Efficient targeted gene disruption in Xenopus embryos using engineered transcription activator-like effector nucleases (TALENs). Proc Natl Acad Sci U S A. Oct. 23, 2012;109(43):17484-9. Doi: 10.1073/pnas.1215421109. Epub Oct. 8, 2012.
Li et al., Modularly assembled designer TAL effector nucleases for targeted gene knockout and gene replacement in eukaryotes. Nucleic Acids Res. Aug. 2011;39(14):6315-25. doi: 10.1093/nar/gkr188. Epub Mar. 31, 2011.
Li et al., TAL nucleases (TALNs): hybrid proteins composed of TAL effectors and FokI DNA-cleavage domain. Nucleic Acids Res. Jan. 2011;39(1):359-72. doi: 10.1093/nar/gkq704. Epub Aug. 10, 2010.
Liu et al., Cell-penetrating peptide-mediated delivery of TALEN proteins via bioconjugation for genome engineering. PLoS One. Jan. 20, 2014;9(1):e85755. doi: 10.1371/journal.pone.0085755. eCollection 2014.
Liu et al., Design of polydactyl zinc-finger proteins for unique addressing within complex genomes. Proc Natl Acad Sci U S A. May 27, 1997;94(11):5525-30.
Lombardo et al., Gene editing in human stem cells using zinc finger nucleases and integrase-defective lentiviral vector delivery. Nat Biotechnol. Nov. 2007;25(11):1298-306. Epub Oct. 28, 2007.
Maeder et al., CRISPR RNA-guided activation of endogenous human genes. Nat Methods. Oct. 2013;10(10):977-9. doi: 10.1038/nmeth.2598. Epub Jul. 25, 2013.

Maeder et al., Rapid "open-source" engineering of customized zinc-finger nucleases for highly efficient gene modification. Mol Cell. Jul. 25, 2008;31(2):294-301. doi:10.1016/j.molcel.2008.06.016.
Maeder et al., Robust, synergistic regulation of human gene expression using TALE activators. Nat Methods. Mar. 2013;10(3):243-5. doi: 10.1038/nmeth.2366. Epub Feb. 10, 2013.
Mahfouz et al., De novo-engineered transcription activator-like effector (TALE) hybrid nuclease with novel DNA binding specificity creates double-strand breaks. Proc Natl Acad Sci U S A. Feb. 8, 2011;108(6):2623-8. doi: 10.1073/pnas.1019533108. Epub Jan. 24, 2011.
Mak et al., The crystal structure of TAL effector PthXo1 bound to its DNA target. Science. Feb. 10, 2012;335(6069):716-9. doi: 10.1126/science.1216211. Epub Jan. 5, 2012.
Mali et al., Cas9 as a versatile tool for engineeringbiology. Nat Methods. Oct. 2013;10(10):957-63. doi: 10.1038/nmeth.2649.
Mali et al., CAS9 transcriptional activators for target specificity screening and paired nickases for cooperative genome engineering. Nat Biotechnol. Sep. 2013;31(9):833-8. doi: 10.1038/nbt.2675. Epub Aug. 1, 2013.
Mali et al., RNA-guided human genome engineering via Cas9. Science. Feb. 15, 2013;339(6121):823-6. doi: 10.1126/science.1232033. Epub Jan. 3, 2013.
Mani et al., Design, engineering, and characterization of zinc finger nucleases. Biochem Biophys Res Commun. Sep. 23, 2005;335(2):447-57.
Meckler et al., Quantitative analysis of TALE-DNA interactions suggests polarity effects. Nucleic Acids Res. Apr. 2013;41(7):4118-28. doi: 10.1093/nar/gkt085. Epub Feb. 13, 2013.
Meng et al., Profiling the DNA-binding specificities of engineered Cys2His2 zinc finger domains using a rapid cell-based method. Nucleic Acids Res. 2007;35(11):e81. Epub May 30, 2007.
Meng et al., Targeted gene inactivation in zebrafish using engineered zinc-finger nucleases. Nat Biotechnol. Jun. 2008;26(6):695-701. doi: 10.1038/nbt1398. Epub May 25, 2008.
Miller et al., A TALE nuclease architecture for efficient genome editing. Nat Biotechnol. Feb. 2011;29(2):143-8. doi:10.1038/nbt.1755. Epub Dec. 22, 2010.
Miller et al., An improved zinc-finger nuclease architecture for highly specific genome editing. Nat Biotechnol. Jul. 2007;25(7):778-85. Epub Jul. 1, 2007.
Moore et al., Improved somatic mutagenesis in zebrafish using transcription activator-like effector nucleases (TALENs). PloS One. 2012;7(5):e37877. Doi: 10.1371/journal.pone.0037877. Epub May 24, 2012.
Morbitzer et al., Assembly of custom TALE-type DNA binding domains by modular cloning. Nucleic Acids Res. Jul. 2011;39(13):5790-9. doi: 10.1093/nar/gkr151. Epub Mar. 18, 2011.
Moscou et al., A simple cipher governs DNA recognition by TAL effectors. Science. Dec. 11, 2009;326(5959):1501. doi: 10.1126/science.1178817.
Mussolino et al., A novel TALE nuclease scaffold enables high genome editing activity in combination with low toxicity. Nucleic Acids Res. Nov. 2011;39(21):9283-93. Doi: 10.1093/nar/gkr597. Epub Aug. 3, 2011.
Narayanan et al., Clamping down on weak terminal base pairs: oligonucleotides with molecular caps as fidelity-enhancing elements at the 5'- and 3'- terminal residues. Nucleic Acids Res. May 20, 2004;32(9):2901-11. Print 2004.
Nishimasu et al., Crystal structure of Cas9 in complex with guide RNA and target DNA. Cell. Feb. 27, 2014;156(5):935-49. doi: 10.1016/j.cell.2014.02.001. Epub Feb. 13, 2014.
Osborn et al., TALEN-based gene correction for epidermolysis bullosa. Mol Ther. Jun. 2013;21(6):1151-9. doi: 10.1038/mt.2013.56. Epub Apr. 2, 2013.
Pabo et al., Design and selection of novel Cys2His2 zinc finger proteins. Annu Rev Biochem. 2001;70:313-40.
Pan et al., Biological and biomedical applications of engineered nucleases. Mol Biotechnol. Sep. 2013;55(1):54-62. doi: 10.1007/s12033-012-9613-9.

(56) References Cited

OTHER PUBLICATIONS

Pattanayak et al., High-throughput profiling of off-target DNA cleavage reveals RNA-programmed Cas9 nuclease specificity. Nat Biotechnol. Sep. 2013;31(9):839-43. doi: 10.1038/nbt.2673. Epub Aug. 11, 2013.

Pattanayak et al., Revealing off-target cleavage specificities of zinc-finger nucleases by in vitro selection. Nat Methods. Aug. 7, 2011;8(9):765-70. doi: 10.1038/nmeth.1670.

Pavletich et al., Zinc finger-DNA recognition: crystal structure of a Zif268-DNA complex at 2.1 A. Science. May 10, 1991;252(5007):809-17.

Pennisi et al., The CRISPR craze. Science. Aug. 23, 2013;341(6148):833-6. doi: 10.1126/science.341.6148.833.

Pennisi et al., The tale of the TALEs. Science. Dec. 14, 2012;338(6113):1408-11. doi: 10.1126/science.338.6113.1408.

Perez et al., Establishment of HIV-1 resistance in CD4+ T cells by genome editing using zinc-finger nucleases. Nat Biotechnol. Jul. 2008;26(7):808-16. Doi: 10.1038/nbt1410. Epub Jun. 29, 2008.

Perez-Pinera et al., Advances in targeted genome editing. Curr Opin Chem Biol. Aug. 2012;16(3-4):268-77. doi: 10.1016/j.cbpa.2012.06.007. Epub Jul. 20, 2012.

Perez-Pinera et al., RNA-guided gene activation by CRISPR-Cas9-based transcription factors. Nat Methods. Oct. 2013;10(10):973-6. doi: 10.1038/nmeth.2600. Epub Jul. 25, 2013.

Petek et al., Frequent endonuclease cleavage at off-target locations in vivo. Mol Ther. May 2010;18(5):983-6. Doi: 10.1038/mt.2010.35. Epub Mar. 9, 2010.

Porteus, Design and testing of zinc finger nucleases for use in mammalian cells. Methods Mol Biol. 2008;435:47-61. doi: 10.1007/978-1-59745-232-8_4.

Proudfoot et al., Zinc finger recombinases with adaptable DNA sequence specificity. PLoS One. Apr. 29, 2011;6(4):e19537. doi: 10.1371/journal.pone.0019537.

Qi et al., Repurposing CRISPR as an RNA-guided platform for sequence-specific control of gene expression. Cell. Feb. 28, 2013;152(5):1173-83. doi: 10.1016/j.cell.2013.02.022.

Ramirez et al., Engineered zinc finger nickases induce homology-directed repair with reduced mutagenic effects. Nucleic Acids Res. Jul. 2012;40(12):5560-8. doi: 10.1093/nar/gks179. Epub Feb. 28, 2012.

Ramirez et al., Unexpected failure rates for modular assembly of engineered zinc fingers. Nat Methods. May 2008;5(5):374-5. Doi: 10.1038/nmeth0508-374.

Ran et al., Double nicking by RNA-guided CRISPR Cas9 for enhanced genome editing specificity. Cell. Sep. 12, 2013;154(6):1380-9. doi: 10.1016/j.cell.2013.08.021. Epub Aug. 29, 2013.

Reyon et al., FLASH assembly of TALENs for high-throughput genome editing. Nat Biotechnol. May 2012;30(5):460-5. doi: 10.1038/nbt.2170.

Sander et al., CRISPR-Cas systems for editing, regulating and targeting genomes. Nat Biotechnol. Apr. 2014;32(4):347-55. doi: 10.1038/nbt.2842. Epub Mar. 2, 2014.

Sander et al., In silico abstraction of zinc finger nuclease cleavage profiles reveals an expanded landscape of off-target sites. Nucleic Acids Res. Oct. 2013;41(19):e181. doi: 10.1093/nar/gkt716. Epub Aug. 14, 2013.

Sander et al., Targeted gene disruption in somatic zebrafish cells using engineered TALENs. Nat Biotechnol. Aug. 5, 2011;29(8):697-8. doi: 10.1038/nbt.1934.

Santiago et al., Targeted gene knockout in mammalian cells by using engineered zinc-finger nucleases. Proc Natl Acad Sci U S A. Apr. 15, 2008;105(15):5809-14. doi: 10.1073/pnas.0800940105. Epub Mar. 21, 2008.

Sapranauskas et al., The *Streptococcus thermophilus* CRISPR/Cas system provides immunity in *Escherichia coli*. Nucleic Acids Res. Nov. 2011;39(21):9275-82. doi: 10.1093/nar/gkr606. Epub Aug. 3, 2011.

Sashital et al., Mechanism of foreign DNA selection in a bacterial adaptive immune system. Mol Cell. Jun. 8, 2012;46(5):606-15. doi: 10.1016/j.molcel.2012.03.020. Epub Apr. 19, 2012.

Schriefer et al., Low pressure DNA shearing: a method for random DNA sequence analysis. Nucleic Acids Res. Dec. 25, 1990;18(24):7455-6.

Schwank et al., Functional repair of CFTR by CRISPR/Cas9 in intestinal stem cell organoids of cystic fibrosis patients. Cell Stem Cell. Dec. 5, 2013;13(6):653-8. doi:10.1016/j.stem.2013.11.002.

Segal et al., Evaluation of a modular strategy for the construction of novel polydactyl zinc finger DNA-binding proteins. Biochemistry. Feb. 25, 2003;42(7):2137-48.

Segal et al., Toward controlling gene expression at will: selection and design of zinc finger domains recognizing each of the 5'-GNN-3' DNA target sequences. Proc Natl Acad Sci U S A. Mar. 16, 1999;96(6):2758-63.

Semenova et al., Interference by clustered regularly interspaced short palindromic repeat (CRISPR) RNA is governed by a seed sequence. Proc Natl Acad Sci U S A. Jun. 21, 2011;108(25):10098-103. doi: 10.1073/pnas.1104144108. Epub Jun. 6, 2011.

Shalem et al., Genome-scale CRISPR-Cas9 knockout screening in human cells. Science. Jan. 3, 2014;343(6166):84-7. doi: 10.1126/science.1247005. Epub Dec. 12, 2013.

Sheridan, First CRISPR-Cas patent opens race to stake out intellectual property. Nat Biotechnol. 2014;32(7):599-601.

Sheridan, Gene therapy finds its niche. Nat Biotechnol. Feb. 2011;29(2):121-8. doi: 10.1038/nbt.1769.

Shimizu et al., Adding fingers to an engineered zinc finger nuclease can reduce activity. Biochemistry. Jun. 7, 2011;50(22):5033-41. doi: 10.1021/bi200393g. Epub May 11, 2011.

Siebert et al., An improved PCR method for walking in uncloned genomic DNA. Nucleic Acids Res. Mar. 25, 1995;23(6):1087-8.

Sun et al., Optimized TAL effector nucleases (TALENs) for use in treatment of sickle cell disease. Mol Biosyst. Apr. 2012;8(4):1255-63. doi: 10.1039/c2mb05461b. Epub Feb. 3, 2012.

Szczepek et al., Structure-based redesign of the dimerization interface reduces the toxicity of zinc-finger nucleases. Nat Biotechnol. Jul. 2007;25(7):786-93. Epub Jul. 1, 2007.

Tebas et al., Gene editing of CCR5 in autologous CD4 T cells of persons infected with HIV. N Engl J Med. Mar. 6, 2014;370(10):901-10. doi: 10.1056/NEJMoa1300662.

Tesson et al., Knockout rats generated by embryo microinjection of TALENs. Nat Biotechnol. Aug. 5, 2011;29(8):695-6. doi: 10.1038/nbt.1940.

Tsai et al., Dimeric CRISPR RNA-guided FokI nucleases for highly specific genome editing. Nat Biotechnol. Jun. 2014;32(6):569-76. doi: 10.1038/nbt.2908. Epub Apr. 25, 2014.

Turan et al., Site-specific recombinases: from tag-and-target- to tag-and-exchange-based genomic modifications. FASEB J. Dec. 2011;25(12):4088-107. doi: 10.1096/fj.11-186940. Epub Sep. 2, 2011. Review.

Urnov et al., Genome editing with engineered zinc finger nucleases. Nat Rev Genet. Sep. 2010;11(9):636-46. doi: 10.1038/nrg2842.

Urnov et al., Highly efficient endogenous human gene correction using designed zinc-finger nucleases. Nature. Jun. 2, 2005;435(7042):646-51. Epub Apr. 3, 2005.

Van Duyne et al., Teaching Cre to follow directions. Proc Natl Acad Sci U S A. Jan. 6, 2009;106(1):4-5. doi: 10.1073/pnas.0811624106. Epub Dec. 31, 2008.

Vanamee et al., FokI requires two specific DNA sites for cleavage. J Mol Biol. May 25, 2001;309(1):69-78.

Wah et al., Structure of FokI has implications for DNA cleavage. Proc Natl Acad Sci U S A. Sep. 1, 1998;95(18):10564-9.

Wang et al., Genetic screens in human cells using the CRISPR-Cas9 system. Science. Jan. 3, 2014;343(6166):80-4. doi: 10.1126/science.1246981. Epub Dec. 12, 2013.

Wang et al., One-step generation of mice carrying mutations in multiple genes by CRISPR/Cas-mediated genome engineering. Cell. May 9, 2013;153(4):910-8. doi: 10.1016/j.cell.2013.04.025. Epub May 2, 2013.

(56) References Cited

OTHER PUBLICATIONS

Wang et al., Targeted gene addition to a predetermined site in the human genome using a ZFN-based nicking enzyme. Genome Res. Jul. 2012;22(7):1316-26. doi: 10.1101/gr.122879.111. Epub Mar. 20, 2012.
Weber et al., Assembly of designer TAL effectors by Golden Gate cloning. PLoS One. 2011;6(5):e19722. doi:10.1371/journal.pone.0019722. Epub May 19, 2011.
Wiedenheft et al., RNA-guided genetic silencing systems in bacteria and archaea. Nature. Feb. 15, 2012;482(7385):331-8. doi: 10.1038/nature10886. Review.
Wolfe et al., Analysis of zinc fingers optimized via phage display: evaluating the utility of a recognition code. J Mol Biol. Feb. 5, 1999;285(5):1917-34.
Wood et al., Targeted genome editing across species using ZFNs and TALENs. Science. Jul. 15, 2011;333(6040):307. doi: 10.1126/science.1207773. Epub Jun. 23, 2011.
Wu et al., Correction of a genetic disease in mouse via use of CRISPR-Cas9. Cell Stem Cell. Dec. 5, 2013;13(6):659-62. doi: 10.1016/j.stem.2013.10.016.
Yanover et al., Extensive protein and DNA backbone sampling improves structure-based specificity prediction for C2H2 zinc fingers. Nucleic Acids Res. Jun. 2011;39(11):4564-76. doi: 10.1093/nar/gkr048. Epub Feb. 22, 2011.
Yin et al., Genome editing with Cas9 in adult mice corrects a disease mutation and phenotype. Nat Biotechnol. Jun. 2014;32(6):551-3. doi: 10.1038/nbt.2884. Epub Mar. 30, 2014.
Zhang et al., Conditional gene manipulation: Cre-ating a new biological era. J Zhejiang Univ Sci B. Jul. 2012;13(7):511-24. doi: 10.1631/jzus.B1200042. Review.
Zhang et al., Efficient construction of sequence-specific TAL effectors for modulating mammalian transcription. Nat Biotechnol. Feb. 2011;29(2):149-53. doi: 10.1038/nbt.1775. Epub Jan. 19, 2011.
Zou et al., Gene targeting of a disease-related gene in human induced pluripotent stem and embryonic stem cells. Cell Stem Cell. Jul. 2, 2009;5(1):97-110. doi: 10.1016/j.stem.2009.05.023. Epub Jun. 18, 2009.
Partial Supplementary European Search Report for Application No. EP 12845790.0, mailed Mar. 18, 2015.
International Search Report and Written Opinion for PCT/US2014/052231, mailed Dec. 4, 2014.
International Search Report and Written Opinion for PCT/US2014/052231, mailed Jan. 30, 2015.
International Search Report and Written Opinion for PCT/US2014/054247, mailed Mar. 27, 2015.
International Search Report and Written Opinion for PCT/US2014/054291, mailed Mar. 27, 2015.
Invitation to Pay Additional Fees for PCT/US2014/054291, mailed Dec. 18, 2014.
International Search Report and Written Opinion for PCT/US2014/054252, mailed Mar. 5, 2015.
International Search Report and Written Opinion for PCT/US2014/070038, mailed Apr. 14, 2015.
Boeckle et al., Melittin analogs with high lytic activity at endosomal pH enhance transfection with purified targeted PEI polyplexes. J Control Release. May 15, 2006;112(2):240-8. Epub Mar. 20, 2006.
Branden and Tooze, Introduction to Protein Structure. 1999; 2nd edition. Garland Science Publisher: 3-12.
Cameron, Recent advances in transgenic technology. Mol Biotechnol. Jun. 1997;7(3):253-65.
Caron et al., Intracellular delivery of a Tat-eGFP fusion protein into muscle cells. Mol Ther. Mar. 2001;3(3):310-8.
Chung-Il et al., Artificial control of gene expression in mammalian cells by modulating RNA interference through aptamer-small molecule interaction. RNA. May 2006;12(5):710-6. Epub Apr. 10, 2006.
Cradick et al., ZFN-site searches genomes for zinc finger nuclease target sites and off-target sites. BMC Bioinformatics. May 13, 2011;12:152. doi: 10.1186/1471-2105-12-152.
Gilleron et al., Image-based analysis of lipid nanoparticle-mediated siRNA delivery, intracellular trafficking and endosomal escape. Nat Biotechnol. Jul. 2013;31(7):638-46. doi: 10.1038/nbt.2612. Epub Jun. 23, 2013.
Guo et al., Protein tolerance to random amino acid change. J Gene Med. Mar.-Apr. 2002;4(2):195-204.
Hasadsri et al., Functional protein delivery into neurons using polymeric nanoparticles. J Biol Chem. Mar. 13, 2009;284(11):6972-81. doi: 10.1074/jbc.M805956200. Epub Jan. 7, 2009.
Hill et al., Functional analysis of conserved histidines in ADP-glucose pyrophosphorylase from *Escherichia coli*.Biochem Biophys Res Commun. Mar. 17, 1998;244(2):573-7.
Houdebine, The methods to generate transgenic animals and to control transgene expression. J Biotechnol. Sep. 25, 2002;98(2-3):145-60.
Kappel et al., Regulating gene expression in transgenic animals.Curr Opin Biotechnol. Oct. 1992;3(5):548-53.
Klauser et al., An engineered small RNA-mediated genetic switch based on a ribozyme expression platform. Nucleic Acids Res. May 1, 2013;41(10):5542-52. doi: 10.1093/nar/gkt253. Epub Apr. 12, 2013.
Lazar et al., Transforming growth factor alpha: mutation of aspartic acid 47 and leucine 48 results in different biological activities. Mol Cell Biol. Mar. 1988;8(3):1247-52.
Lewis et al., A serum-resistant cytofectin for cellular delivery of antisense oligodeoxynucleotides and plasmid DNA. Proc Natl Acad Sci U S A. Apr. 16, 1996;93(8):3176-81.
Liu et al., Fast Colorimetric Sensing of Adenosine and Cocaine Based on a General Sensor Design Involving Aptamers and Nanoparticles. Angew Chem. 2006;118(1):96-100.
Lundberg et al., Delivery of short interfering RNA using endosomolytic cell-penetrating peptides. FASEB J. Sep. 2007;21(11):2664-71. Epub Apr. 26, 2007.
Mullins et al., Transgenesis in nonmurine species. Hypertension. Oct. 1993;22(4):630-3.
Mussolino et al., TALE nucleases: tailored genome engineering made easy. Curr Opin Biotechnol. Oct. 2012;23(5):644-50. doi: 10.1016/j.copbio.2012.01.013. Epub Feb. 17, 2012.
NCBI Reference Sequence: NM_002427.3. Wu et al., May 3, 2014. 5 pages.
Nomura et al., Synthetic mammalian riboswitches based on guanine aptazyme. Chem Commun (Camb). Jul. 21, 2012;48(57):7215-7. doi: 10.1039/c2cc33140c. Epub Jun. 13, 2012.
Phillips, The challenge of gene therapy and DNA delivery. J Pharm Pharmacol. Sep. 2001;53(9):1169-74.
Qi et al., Engineering naturally occurring trans-acting non-coding RNAs to sense molecular signals. Nucleic Acids Res. Jul. 2012;40(12):5775-86. doi: 10.1093/nar/gks168. Epub Mar. 1, 2012.
Ramakrishna et al., Gene disruption by cell-penetrating peptide-mediated delivery of Cas9 protein and guide RNA. Genome Res. Jun. 2014;24(6):1020-7. doi: 10.1101/gr.171264.113. Epub Apr. 2, 2014.
Samal et al., Cationic polymers and their therapeutic potential. Chem Soc Rev. Nov. 7, 2012;41(21):7147-94. doi: 10.1039/c2cs35094g. Epub Aug. 10, 2012.
Sang, Prospects for transgenesis in the chick. Mech Dev. Sep. 2004;121(9):1179-86.
Schwarze et al., In vivo protein transduction: delivery of a biologically active protein into the mouse. Science. Sep. 3, 1999;285(5433):1569-72.
Sells et al., Delivery of protein into cells using polycationic liposomes. Biotechniques. Jul. 1995;19(1):72-6, 78.
Thorpe et al., Functional correction of episomal mutations with short DNA fragments and RNA-DNA oligonucleotides. J Gene Med. Mar.-Apr. 2002;4(2):195-204.
Wacey et al., Disentangling the perturbational effects of amino acid substitutions in the DNA-binding domain of p53. Hum Genet. Jan. 1999;104(1):15-22.
Wadia et al., Modulation of cellular function by TAT mediated transduction of full length proteins. Curr Protein Pept Sci. Apr. 2003;4(2):97-104.

(56) References Cited

OTHER PUBLICATIONS

Wadia et al., Transducible TAT-HA fusogenic peptide enhances escape of TAT-fusion proteins after lipid raft macropinocytosis. Nat Med. Mar. 2004;10(3):310-5. Epub Feb. 8, 2004.

Winkler et al., Thiamine derivatives bind messenger RNAs directly to regulate bacterial gene expression. Nature. Oct. 31, 2002;419(6910):952-6. Epub Oct. 16, 2002.

Zelphati et al., Intracellular delivery of proteins with a new lipid-mediated delivery system. J Biol Chem. Sep. 14, 2001;276(37):35103-10. Epub Jul. 10, 2001.

\* cited by examiner

|  | (+) site (5'->3') | (-) site (5'->3') | 4 nM | 2 nM | 1 nM | 0.5 nM |
|---|---|---|---|---|---|---|
| wt | GAT GAG GAT GAC | AAA CTG GAA AAG | X | X | X | X |
| 5-4 | GAT GAG Ggg cga | AAA CTG GAA AAG | X | X | X | X |
| 5-3 | GAT GAG Gca cga | AAA CTG GAA AAG | X | X | X |  |
| 5-2 | GcT GAG GAT aAC | AAA aTG gAA cAG | X | X |  |  |
| 5-1 | GAT aca GAT GAC | AAA CTG gAA AAa | X |  |  |  |

|  | (+) site (5'->3') | (-) site (5'->3') | 4 nM | 2 nM | 1 nM | 0.5 nM |
|---|---|---|---|---|---|---|
| wt | GAG TGA GGA | GAC GCT GCT | X | X | X | X |
| 4-4 | GAG TGA aac | GAC GtT GCT | X | X | X | X |
| 4-3 | GAG TGA Gtc | GAC GtT aCT | X | X | X |  |
| 4-2 | GtG TGA aaA | GAC GtT GCT | X | X |  |  |
| 4-1 | GAG TGA GGA | GAC Gaa aCc | X |  |  |  |

Target Site

TALNS
L18 5'-TTCATTACACCTGCAGCT

TTCATTACACCTGCAGCTCTCATTTTCCATACAGTCAGTATCA
AAGTAATGTGGACGTCGAGAGTAAAAGGTATGTCAGTCATAGT

R18                    AGTATCAATTCTGGAAGA-5'

TALNS
```
L16    5'-TCTTCATTACACCTGC
L13       5'-TCATTACACCTGC
L10          5'-TTACACCTGC
          TCTTCATTACACCTGCAGCTCTCATTTTCCATACAGTCAGTATCA
          AGAAGTAATGTGGACGTCGAGAGTAAAAGGTATGTCAGTCATAGT
R16                                  GTATGTCAGTCATAGT-5'
R13                                  GTATGTCAGTCAT-5'
R10                                  GTATGTCAGT-5'
```

| Length Recognized | TALN Pair | Mutations in Common TS | |
|---|---|---|---|
| | | Mean | Std Dev. |
| 32 | L16+R16 | 1.61 | 1.19 |
| 29 | L16+R13 | 1.43 | 1.36 |
|  | L13+R16 | 1.33 | 1.26 |
| 26 | L16+R10 | 1.04 | 1.09 |
|  | L13+R13 | 1.11 | 1.37 |
|  | L10+R16 | 1.22 | 1.13 |
| 23 | L13+R10 | 0.87 | 1.26 |
|  | L10+R13 | 0.94 | 1.20 |
| 20 | L10+R10 | 0.77 | 1.10 |
|  | Library | 4.17 | 1.97 |

| Length Recognized | TALN Pair | TALN Digestion Mutations in Target Site | | | Pre-Selection Library |
|---|---|---|---|---|---|
| | | Mean | Std Dev. | Std. Error | Mean |
| 32 | L16+R16 | 2.257 | 1.487 | 0.007 | 6.500 |
| 29 | L16+R13 | 1.894 | 1.723 | 0.008 | 5.914 |
| | L13+R16 | 1.735 | 1.567 | 0.007 | 5.969 |
| 26 | L16+R10 | 1.303 | 1.224 | 0.006 | 5.273 |
| | L13+R13 | 1.326 | 1.663 | 0.007 | 5.383 |
| | L10+R16 | 1.516 | 1.260 | 0.006 | 5.396 |
| 23 | L13+R10 | 0.965 | 1.383 | 0.005 | 4.742 |
| | L10+R13 | 1.028 | 1.310 | 0.005 | 4.810 |
| 20 | L10+R10 | 0.769 | 1.101 | 0.004 | 4.169 |

Hypothesis: There are two distinct off-target populations

◯ sites similar to the on-target sequence with exponential enrichment vs. mutations ◯ sites highly mutant to the on-target sequence

EVALUATION AND IMPROVEMENT OF NUCLEASE CLEAVAGE SPECIFICITY

RELATED APPLICATION

This application is a continuation of and claims priority under 35 U.S.C. §120 to U.S. application, U.S. Ser. No. 14/234,031, filed Mar. 24, 2014, which is a national stage filing under 35 U.S.C. §371 of international PCT application, PCT/US2012/047778, filed Jul. 22, 2012, which claims priority under 35 U.S.C. §119(e) to U.S. provisional patent application, U.S. Ser. No. 61/510,841, filed Jul. 22, 2011, the entire contents of each of which are incorporated herein by reference.

GOVERNMENT SUPPORT

This invention was made with U.S. Government support under grant numbers R01 GM065400 and R01 GM088040 awarded by the National Institutes of Health/National Institute of General Medical Sciences, under grant number HR0011-11-2-0003 awarded by the Defense Advanced Research Projects Agency, and under grant number DP1 OD006862 awarded by the National Institutes of Health. The U.S. Government has certain rights in the invention.

BACKGROUND OF THE INVENTION

Site-specific endonucleases theoretically allow for the targeted manipulation of a single site within a genome, and are useful in the context of gene targeting as well as for therapeutic applications. In a variety of organisms, including mammals, site-specific endonucleases, for example, zinc-finger nucleases (ZFNs), have been used for genome engineering by stimulating either non-homologous end joining or homologous recombination. In addition to providing powerful research tools, ZFNs also have potential as gene therapy agents, and two ZFNs have recently entered clinical trials: one, CCR5-2246, targeting a human CCR-5 allele as part of an anti-HIV therapeutic approach (NCT00842634, NCT01044654, NCT01252641), and the other one, VF24684, targeting the human VEGF-A promoter as part of an anti-cancer therapeutic approach (NCT01082926).

Precise targeting of the intended target site is crucial for minimizing undesired off-target effects of site-specific nucleases, particularly in therapeutic applications, as imperfect specificity of some engineered site-specific binding domains has been linked to cellular toxicity. However, the site preferences for engineered site-specific nucleases, including current ZFNs, which cleave their target site after dimerization, has previously only been evaluated in vitro or in silico using methods that are limited to calculating binding and cleavage specificity for monomeric proteins.

Therefore, improved systems for evaluating the off-target sites of nucleases and other nucleic acid cleaving agents are needed and would be useful in the design of nucleases with better specificity, especially for therapeutic applications.

SUMMARY OF THE INVENTION

This invention is at least partly based on the recognition that the reported toxicity of some engineered site-specific endonucleases is based on off-target DNA cleavage, rather than on off-target binding alone. Information about the specificity of site-specific nucleases to date has been based on the assumptions that (i) dimeric nucleases cleave DNA with the same sequence specificity with which isolated monomeric domains bind DNA; and that (ii) the binding of one domain does not influence the binding of the other domain in a given dimeric nuclease. No study to date has reported a method for determining the broad DNA cleavage specificity of active, dimeric site-specific nucleases. Such a method would not only be useful in determining the DNA cleavage specificity of nucleases but would also find use in evaluating the cleavage specificity of other DNA cleaving agents, such as small molecules that cleave DNA.

This invention addresses the shortcomings of previous attempts to evaluate and characterize the sequence specificity of site-specific nucleases, and in particular of nucleases that dimerize or multimerize in order to cleave their target sequence. Some aspects of this invention provide an in vitro selection method to broadly examine the cleavage specificity of active nucleases. In some aspects, the invention provide methods of identifying suitable nuclease target sites that are sufficiently different from any other site within a genome to achieve specific cleavage by a given nuclease without any or at least minimal off-target cleavage. The invention provide methods of evaluating, selecting, and/or designing site specific nucleases with enhanced specificity as compared to current nucleases. Methods for minimizing off-target cleavage by a given nuclease, for example, by enhancing nuclease specificity by designing variant nucleases with binding domains having decreased binding affinity, by lowering the final concentration of the nuclease, and by choosing target sites that differ by at least three base pairs from their closest sequence relatives in the genome are provided. Compositions and kits useful in the practice of the inventive methods are also provided. The provided methods, compositions and kits are also useful in the evaluation, design, and selection of other nucleic acid (e.g., DNA) cleaving agents as would be appreciated by one of skill in the art.

In another aspect, the invention provides nucleases and other nucleic acid cleaving agents designed or selected using the provided system. Isolated ZFNs and TALENs designed, evaluated, or selected according to methods provided herein and pharmaceutical compositions comprising such nucleases are also provided.

Some aspects of this invention provide a method for identifying a target site of a nuclease. In some embodiments, the method comprises (a) providing a nuclease that cuts a double-stranded nucleic acid target site and creates a 5' overhang, wherein the target site comprises a [left-half site]-[spacer sequence]-[right-half site] (LSR) structure, and the nuclease cuts the target site within the spacer sequence. In some embodiments, the method comprises (b) contacting the nuclease with a library of candidate nucleic acid molecules, wherein each nucleic acid molecule comprises a concatemer of a sequence comprising a candidate nuclease target site and a constant insert sequence, under conditions suitable for the nuclease to cut a candidate nucleic acid molecule comprising a target site of the nuclease. In some embodiments, the method comprises (c) filling in the 5' overhangs of a nucleic acid molecule that has been cut twice by the nuclease and comprises a constant insert sequence flanked by a left half-site and cut spacer sequence on one side, and a right half-site and cut spacer sequence on the other side, thereby creating blunt ends. In some embodiments, the method comprises (d) identifying the nuclease target site cut by the nuclease by determining the sequence of the left-half site, the right-half-site, and/or the spacer sequence of the nucleic acid molecule of step (c). In some embodiments, determining the sequence of step (d) comprises ligating sequencing adapters to the blunt ends of the nucleic acid molecule of step (c) and amplifying and/or sequencing the nucleic acid molecule. In some embodiments, the method comprises amplifying the nucleic acid molecule after ligation of the sequencing adapters via PCR. In some embodiments, the method further comprises a step of enriching the nucleic acid molecules of step (c) or step (d) for molecules comprising a single constant insert sequence. In some embodiments, the step of enriching comprises a size fractionation. In some embodiments, the size fractionation is done by gel purification. In some embodiments, the method further comprises discarding any sequences determined in step (d) if the nucleic acid molecule did not comprise a complementary pair of filled-in 5' overhangs. In some embodiments, the method further comprises compiling a plurality of nuclease target sites identified in step (d), thereby generating a nuclease target site profile. In some embodiments, the nuclease is a therapeutic nuclease which cuts a specific nuclease target site in a gene associated with a disease. In some embodiments, the method further comprises determining a maximum concentration of the therapeutic nuclease at which the therapeutic nuclease cuts the specific nuclease target site, and does not cut more than 10, more than 5, more than 4, more than 3, more than 2, more than 1, or no additional nuclease target sites. In some embodiments, the method further comprises administering the therapeutic nuclease to a subject in an amount effective to generate a final concentration equal or lower than the maximum concentration. In some embodiments, the nuclease comprises an unspecific nucleic acid cleavage domain. In some embodiments, the nuclease comprises a FokI cleavage domain. In some embodiments, the nuclease comprises a nucleic acid cleavage domain that cleaves a target sequence upon cleavage domain dimerization. In some embodiments, the nuclease comprises a binding domain that specifically binds a nucleic acid sequence. In some embodiments, the binding domain comprises a zinc finger. In some embodiments, the binding domain comprises at least 2, at least 3, at least 4, or at least 5 zinc fingers. In some embodiments, the nuclease is a Zinc Finger Nuclease. In some embodiments, the binding domain comprises a Transcriptional Activator-Like Element. In some embodiments, the nuclease is a Transcriptional Activator-Like Element Nuclease (TALEN). In some embodiments, the nuclease comprises an organic compound. In some embodiments, the nuclease comprises an enediyne. In some embodiments, the nuclease is an antibiotic. In some embodiments, the compound is dynemicin, neocarzinostatin, calicheamicin, esperamicin, bleomycin, or a derivative thereof. In some embodiments, the nuclease is a homing endonuclease.

Some aspects of this invention provide libraries of nucleic acid molecule. In some embodiments, a library of nucleic acid molecules is provided that comprises a plurality of nucleic acid molecules, wherein each nucleic acid molecule comprises a concatemer of a candidate nuclease target site and a constant insert sequence spacer sequence. In some embodiments, the candidate nuclease target site comprises a [left-half site]-[spacer sequence]-[right-half site] (LSR) structure. In some embodiments, the left-half site and/or the right-half site is between 10-18 nucleotides long. In some embodiments, the library comprises candidate nuclease target sites that can be cleaved by a nuclease comprising a FokI cleavage domain. In some embodiments, the library comprises candidate nuclease target sites that can be cleaved by a Zinc Finger Nuclease (ZFN), a Transcription Activator-Like Effector Nuclease (TALEN), a homing endonuclease, an organic compound nuclease, an enediyne, an antibiotic nuclease, dynemicin, neocarzinostatin, calicheamicin, esperamicin, and/or bleomycin. In some embodiments, the library comprises at least $10^5$, at least $10^6$, at least $10^7$, at least $10^8$, at least $10^9$, at least $10^{10}$, at least $10^{11}$, or at least $10^{12}$ different candidate nuclease target sites. In some embodiments, the library comprises nucleic acid molecules of a molecular weight of at least 5 kDa, at least 6 kDa, at least 7 kDa, at least 8 kDa, at least 9 kDa, at least 10 kDa, at least 12 kDa, or at least 15 kDa. In some embodiments, the candidate nuclease target sites comprise a partially randomized left-half site, a partially randomized right-half site, and/or a partially randomized spacer sequence. In some embodiments, the library is templated on a known target site of a nuclease of interest. In some embodiments, the nuclease of interest is a ZFN, a TALEN, a homing endonuclease, an organic compound nuclease, an enediyne, an antibiotic nuclease, dynemicin, neocarzinostatin, calicheamicin, esperamicin, bleomycin, or a derivative thereof. In some embodiments, partial randomized sites differ from the consensus site by more than 5%, more than 10%, more than 15%, more than 20%, more than 25%, or more than 30% on average, distributed binomially. In some embodiments, partial randomized sites differ from the consensus site by no more than 10%, no more than 15%, no more than 20%, no more than 25%, nor more than 30%, no more than 40%, or no more than 50% on average, distributed binomially. In some embodiments, the candidate nuclease target sites comprise a randomized spacer sequence.

Some aspects of this invention provide methods of selecting a nuclease based on an evaluation of cleavage specificity. In some embodiments, a method of selecting a nuclease that specifically cuts a consensus target site from a plurality of nucleases is provided. In some embodiments, the method comprises (a) providing a plurality of candidate nucleases that cut the same consensus sequence; (b) for each of the candidate nucleases of step (a), identifying a nuclease target site cleaved by the candidate nuclease that differ from the consensus target site; and (c) selecting a nuclease based on the nuclease target site(s) identified in step (b). In some embodiments, the nuclease selected in step (c) is the nuclease that cleaves the consensus target site with the highest specificity. In some embodiments, the nuclease that cleaves the consensus target site with the highest specificity is the candidate nuclease that cleaves the lowest number of target sites that differ from the consensus site. In some embodiments, the candidate nuclease that cleaves the consensus target site with the highest specificity is the candidate nuclease that cleaves the lowest number of target sites that are different from the consensus site in the context of a target genome. In some embodiments, the candidate nuclease selected in step (c) is a nuclease that does not cleave any target site other than the consensus target site. In some embodiments, the candidate nuclease selected in step (c) is a nuclease that does not cleave any target site other than the consensus target site within the genome of a subject at a therapeutically effective concentration of the nuclease. In some embodiments, the method further comprises contacting a genome with the nuclease selected in step (c). In some embodiments, the genome is a vertebrate, mammalian, human, non-human primate, rodent, mouse rat, hamster, goat, sheep, cattle, dog, cat, reptile, amphibian, fish, nematode, insect, or fly genome. In some embodiments, the genome is within a living cell. In some embodiments, the genome is within a subject. In some embodiments, the consensus target site is within an allele that is associated with a disease or disorder. In some embodiments, cleavage of the consensus target site results in treatment or prevention of the disease or disorder. In some embodiments, cleavage of the consensus target site results in the alleviation of a symptom of the disease or disorder. In some embodiments, the disease is HIV/AIDS, or a proliferative disease. In some embodiments, the allele is a CCR5 or VEGFA allele.

Some aspects of this invention provide a method for selecting a nuclease target site within a genome. In some embodiments, the method comprises (a) identifying a candidate nuclease target site; and (b) using a general purpose computer, comparing the candidate nuclease target site to other sequences within the genome, wherein if the candidate nuclease target site differs from any other sequence within the genome by at least 3, at least 4, at least 5, at least 6, at least 7, at least 8, at least 9, or at least 10 nucleotides, selecting the candidate nuclease site. In some embodiments, the candidate nuclease target site comprises a [left-half site]-[spacer sequence]-[right-half site] (LSR) structure. In some embodiments, the left-half site and/or the right-half site is 10-18 nucleotides long. In some embodiments, the spacer is 10-24 nucleotides long. In some embodiments, the method further comprises designing and/or generating a nuclease targeting the candidate nuclease site selected in step (b). In some embodiments, designing and/or generating is done by recombinant technology. In some embodiments, designing and/or generating comprises designing a binding domain that specifically binds the selected candidate target site, or a half-site thereof. In some embodiments, designing and/or generating comprises conjugating the binding domain with a nucleic acid cleavage domain. In some embodiments, the nucleic acid cleavage domain is a non-specific cleavage domain and/or wherein the nucleic acid cleavage domain must dimerize or multimerize in order to cut a nucleic acid. In some embodiments, the nucleic acid cleavage domain comprises a FokI cleavage domain. In some embodiments, the method further comprises isolating the nuclease. In some embodiments, the nuclease is a Zinc Finger Nuclease (ZFN) or a Transcription Activator-Like Effector Nuclease (TALEN), a homing endonuclease, or is or comprises an organic compound nuclease, an enediyne, an antibiotic nuclease, dynemicin, neocarzinostatin, calicheamicin, esperamicin, bleomycin, or a derivative thereof. In some embodiments, the candidate target site is within a genomic sequence the cleavage of which is known to be associated with an alleviation of a symptom of a disease or disorder. In some embodiments, the disease is HIV/AIDS, or a proliferative disease. In some embodiments, the genomic sequence is a CCR5 or VEGFA sequence.

Some aspects of this invention provide isolated nucleases with enhanced specificity and nucleic acids encoding such nucleases. In some embodiments, an isolated nuclease is provided that has been engineered to cleave a target site within a genome, wherein the nuclease has been selected according to any of the selection methods described herein. In some embodiments, an isolated nuclease is provided that cuts a target site selected according to any of the methods described herein. In some embodiments, an isolated nuclease is provided that is designed or engineered according to any of the concepts or parameters described herein. In some embodiments, the nuclease is a Zinc Finger Nuclease (ZFN) or a Transcription Activator-Like Effector Nuclease (TALEN), a homing endonuclease, or is or comprises an organic compound nuclease, an enediyne, an antibiotic nuclease, dynemicin, neocarzinostatin, calicheamicin, esperamicin, bleomycin, or a derivative thereof.

Some aspects of this invention provide kits comprising nucleases and nuclease compositions. In some embodiments, a kit is provided that comprises an isolated nuclease described herein. In some embodiments, the kit further comprises a nucleic acid comprising a target site of the isolated nuclease. In some embodiments, the kit comprises an excipient and instructions for contacting the nuclease with the excipient to generate a composition suitable for contacting a nucleic acid with the nuclease. In some embodiments, the nucleic acid is a genome or part of a genome. In some embodiments, the genome is within a cell. In some embodiments, the genome is within a subject and the excipient is a pharmaceutically acceptable excipient.

Some aspects of this invention provide pharmaceutical compositions comprising a nuclease or a nucleic acid encoding a nuclease as described herein. In some embodiments, pharmaceutical composition for administration to a subject is provided. In some embodiments, the composition comprises an isolated nuclease described herein or a nucleic acid encoding such a nuclease and a pharmaceutically acceptable excipient.

Other advantages, features, and uses of the invention will be apparent from the detailed description of certain non-limiting embodiments; the drawings, which are schematic and not intended to be drawn to scale; and the claims.

DEFINITIONS

Figure 1:
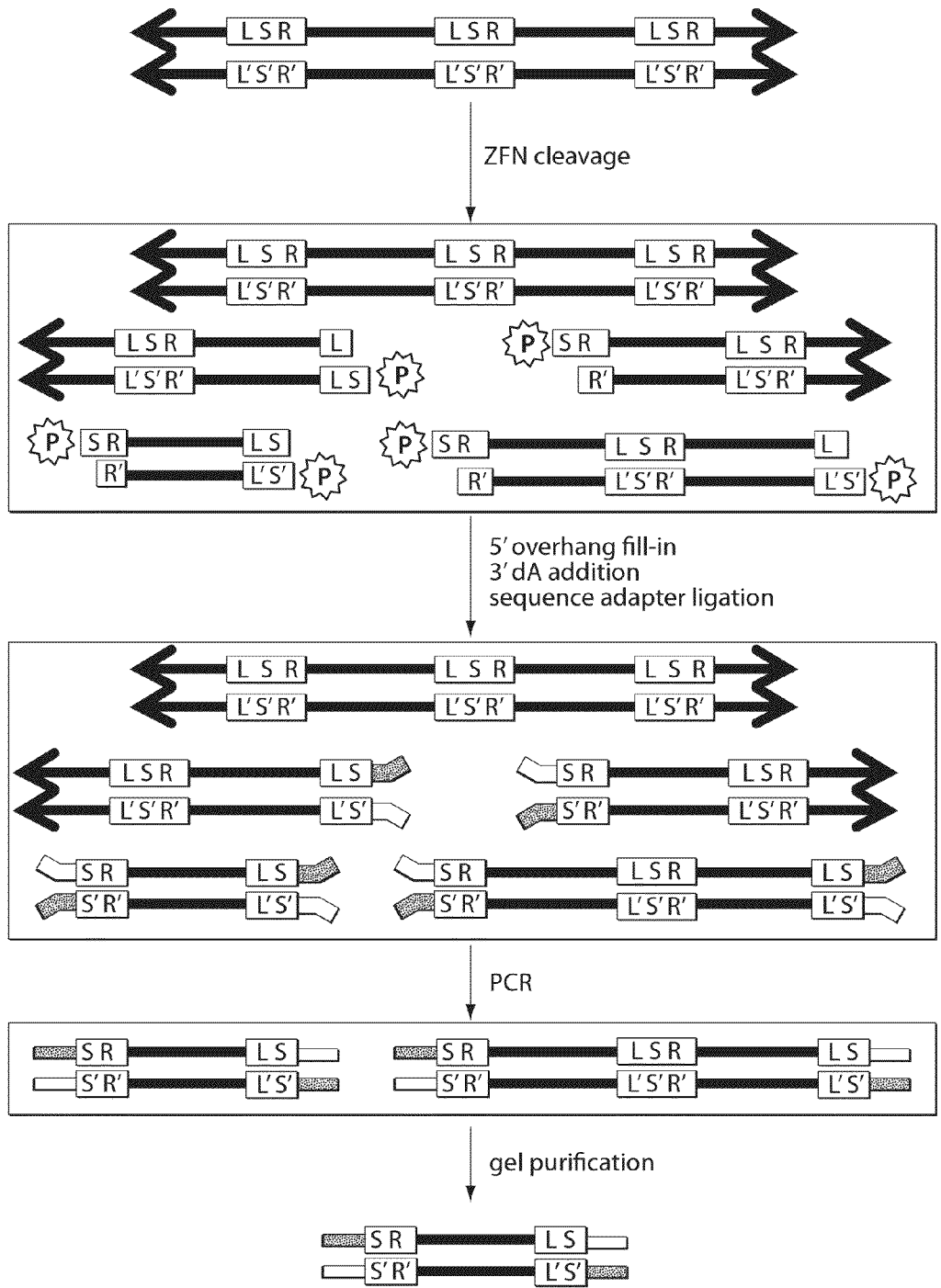
FIG. 1. In vitro selection for ZFN-mediated cleavage. Pre-selection library members are concatemers (represented by arrows) of identical ZFN target sites lacking 5' phosphates. L=left half-site; R=right half-site, S=spacer; L', S', R'=complementary sequences to L, S, R. ZFN cleavage reveals a 5' phosphate, which is required for sequencing adapter ligation. The only sequences that can be amplified by PCR using primers complementary to the adapters are sequences that have been cleaved twice and have adapters on both ends. DNA cleaved at adjacent sites are purified by gel electrophoresis and sequenced. A computational screening step after sequencing ensures that the filled-in spacer sequences (S and S') are complementary and therefore from the same molecule.

As used herein and in the claims, the singular forms "a," "an," and "the" include the singular and the plural reference unless the context clearly indicates otherwise. Thus, for example, a reference to "an agent" includes a single agent and a plurality of such agents.

The term "concatemer," as used herein in the context of nucleic acid molecules, refers to a nucleic acid molecule that contains multiple copies of the same DNA sequences linked in a series. For example, a concatemer comprising ten copies of a specific sequence of nucleotides (e.g., $[XYZ]_{10}$), would comprise ten copies of the same specific sequence linked to each other in series, e.g., 5'-XYZXYZXYZXYZXYZX-YZXYZXYZXYZXYZ-3'. A concatemer may comprise any number of copies of the repeat unit or sequence, e.g., at least 2 copies, at least 3 copies, at least 4 copies, at least 5 copies, at least 10 copies, at least 100 copies, at least 1000 copies, etc. An example of a concatemer of a nucleic acid sequence comprising a nuclease target site and a constant insert sequence would be [(target site)-(constant insert sequence)]$_{300}$. A concatemer may be a linear nucleic acid molecule, or may be circular.

The terms "conjugating," "conjugated," and "conjugation" refer to an association of two entities, for example, of two molecules such as two proteins, two domains (e.g., a binding domain and a cleavage domain), or a protein and an agent, e.g., a protein binding domain and a small molecule. The association can be, for example, via a direct or indirect (e.g., via a linker) covalent linkage or via non-covalent interactions. In some embodiments, the association is covalent. In some embodiments, two molecules are conjugated via a linker connecting both molecules. For example, in some embodiments where two proteins are conjugated to each other, e.g., a binding domain and a cleavage domain of an engineered nuclease, to form a protein fusion, the two proteins may be conjugated via a polypeptide linker, e.g., an amino acid sequence connecting the C-terminus of one protein to the N-terminus of the other protein.

The term "consensus sequence," as used herein in the context of nucleic acid sequences, refers to a calculated sequence representing the most frequent nucleotide residues found at each position in a plurality of similar sequences. Typically, a consensus sequence is determined by sequence alignment in which similar sequences are compared to each other and similar sequence motifs are calculated. In the context of nuclease target site sequences, a consensus sequence of a nuclease target site may, in some embodiments, be the sequence most frequently bound, or bound with the highest affinity, by a given nuclease.

The term "effective amount," as used herein, refers to an amount of a biologically active agent that is sufficient to elicit a desired biological response. For example, in some embodiments, an effective amount of a nuclease may refer to the amount of the nuclease that is sufficient to induce cleavage of a target site specifically bound and cleaved by the nuclease. As will be appreciated by the skilled artisan, the effective amount of an agent, e.g., a nuclease, a hybrid protein, or a polynucleotide, may vary depending on various factors as, for example, on the desired biological response, the specific allele, genome, target site, cell, or tissue being targeted, and the agent being used.

The term "enediyne," as used herein, refers to a class of bacterial natural products characterized by either nine- and ten-membered rings containing two triple bonds separated by a double bond (see, e.g., K. C. Nicolaou; A. L. Smith; E. W. Yue (1993). "Chemistry and biology of natural and designed enediynes". PNAS 90 (13): 5881-5888; the entire contents of which are incorporated herein by reference). Some enediynes are capable of undergoing Bergman cyclization, and the resulting diradical, a 1,4-dehydrobenzene derivative, is capable of abstracting hydrogen atoms from the sugar backbone of DNA which results in DNA strand cleavage (see, e.g., S. Walker; R. Landovitz; W. D. Ding; G. A. Ellestad; D. Kahne (1992). "Cleavage behavior of calicheamicin gamma 1 and calicheamicin T". Proc Natl Acad Sci U.S.A. 89 (10): 4608-12; the entire contents of which are incorporated herein by reference). Their reactivity with DNA confers an antibiotic character to many enediynes, and some enediynes are clinically investigated as anticancer antibiotics. Nonlimiting examples of enediynes are dynemicin, neocarzinostatin, calicheamicin, esperamicin (see, e.g., Adrian L. Smith and K. C. Bicolaou, "The Enediyne Antibiotics" J. Med. Chem., 1996, 39 (11), pp 2103-2117; and Donald Borders, "Enediyne antibiotics as antitumor agents," Informa Healthcare; 1$^{st}$ edition (Nov. 23, 1994, ISBN-10: 0824789385; the entire contents of which are incorporated herein by reference).

The term "homing endonuclease," as used herein, refers to a type of restriction enzymes typically encoded by introns or inteins Edgell DR (February 2009). "Selfish DNA: homing endonucleases find a home". Curr Biol 19 (3): R115-R117; Jasin M (June 1996). "Genetic manipulation of genomonth with rare-cutting endonucleases". Trends Genet 12 (6): 224-8; Burt A, Koufopanou V (December 2004). "Homing endonuclease genes: the rise and fall and rise again of a selfish element". Curr Opin Genet Dev 14 (6): 609-15; the entire contents of which are incorporated herein by reference. Homing endonuclease recognition sequences are long enough to occur randomly only with a very low probability (approximately once every $7 \times 10^{10}$ bp), and are normally found in only one instance per genome.

The term "library," as used herein in the context of nucleic acids or proteins, refers to a population of two or more different nucleic acids or proteins, respectively. For example, a library of nuclease target sites comprises at least two nucleic acid molecules comprising different nuclease target sites. In some embodiments, a library comprises at least $10^1$, at least $10^2$, at least $10^3$, at least $10^4$, at least $10^5$, at least $10^6$, at least $10^7$, at least $10^8$, at least $10^9$, at least $10^{10}$, at least $10^{11}$, at least $10^{12}$, at least $10^{13}$, at least $10^{14}$, or at least $10^{15}$ different nucleic acids or proteins. In some embodiments, the members of the library may comprise randomized sequences, for example, fully or partially randomized sequences. In some embodiments, the library comprises nucleic acid molecules that are unrelated to each other, e.g., nucleic acids comprising fully randomized sequences. In other embodiments, at least some members of the library may be related, for example, they may be variants or derivatives of a particular sequence, such as a consensus target site sequence.

The term "linker," as used herein, refers to a chemical group or a molecule linking two adjacent molecules or moieties, e.g., a binding domain and a cleavage domain of a nuclease. Typically, the linker is positioned between, or flanked by, two groups, molecules, or other moieties and connected to each one via a covalent bond, thus connecting the two. In some embodiments, the linker is an amino acid or a plurality of amino acids (e.g., a peptide or protein). In some embodiments, the linker is an organic molecule, group, polymer, or chemical moiety.

The term "nuclease," as used herein, refers to an agent, for example a protein or a small molecule, capable of cleaving a phosphodiester bond connecting nucleotide residues in a nucleic acid molecule. In some embodiments, a nuclease is a protein, e.g., an enzyme that can bind a nucleic acid molecule and cleave a phosphodiester bond connecting nucleotide residues within the nucleic acid molecule. A nuclease may be an endonuclease, cleaving a phosphodiester bonds within a polynucleotide chain, or an exonuclease, cleaving a phosphodiester bond at the end of the polynucleotide chain. In some embodiments, a nuclease is a site-specific nuclease, binding and/or cleaving a specific phosphodiester bond within a specific nucleotide sequence, which is also referred to herein as the "recognition sequence," the "nuclease target site," or the "target site." In some embodiments, a nuclease recognizes a single stranded target site, while in other embodiments, a nuclease recognizes a double-stranded target site, for example a double-stranded DNA target site. The target sites of many naturally occurring nucleases, for example, many naturally occurring DNA restriction nucleases, are well known to those of skill in the art. In many cases, a DNA nuclease, such as EcoRI, HindIII, or BamHI, recognize a palindromic, double-stranded DNA target site of 4 to 10 base pairs in length, and cut each of the two DNA strands at a specific position within the target site. Some endonucleases cut a double-stranded nucleic acid target site symmetrically, i.e., cutting both strands at the same position so that the ends comprise base-paired nucleotides, also referred to herein as blunt ends. Other endonucleases cut a double-stranded nucleic acid target site asymmetrically, i.e., cutting each strand at a different position so that the ends comprise unpaired nucleotides. Unpaired nucleotides at the end of a double-stranded DNA molecule are also referred to as "overhangs," e.g., as "5'-overhang" or as "3'-overhang," depending on whether the unpaired nucleotide(s) form(s) the 5' or the 5' end of the respective DNA strand. Double-stranded DNA molecule ends ending with unpaired nucleotide(s) are also referred to as sticky ends, as they can "stick to" other double-stranded DNA molecule ends comprising complementary unpaired nucleotide(s). A nuclease protein typically comprises a "binding domain" that mediates the interaction of the protein with the nucleic acid substrate, and also, in some cases, specifically binds to a target site, and a "cleavage domain" that catalyzes the cleavage of the phosphodiester bond within the nucleic acid backbone. In some embodiments a nuclease protein can bind and cleave a nucleic acid molecule in a monomeric form, while, in other embodiments, a nuclease protein has to dimerize or multimerize in order to cleave a target nucleic acid molecule. Binding domains and cleavage domains of naturally occurring nucleases, as well as modular binding domains and cleavage domains that can be fused to create nucleases binding specific target sites, are well known to those of skill in the art. For example, zinc fingers or transcriptional activator like elements can be used as binding domains to specifically bind a desired target site, and fused or conjugated to a cleavage domain, for example, the cleavage domain of FokI, to create an engineered nuclease cleaving the target site.

The terms "nucleic acid" and "nucleic acid molecule," as used herein, refers to a compound comprising a nucleobase and an acidic moiety, e.g., a nucleoside, a nucleotide, or a polymer of nucleotides. Typically, polymeric nucleic acids, e.g., nucleic acid molecules comprising three or more nucleotides are linear molecules, in which adjacent nucleotides are linked to each other via a phosphodiester linkage. In some embodiments, "nucleic acid" refers to individual nucleic acid residues (e.g. nucleotides and/or nucleosides). In some embodiments, "nucleic acid" refers to an oligonucleotide chain comprising three or more individual nucleotide residues. As used herein, the terms "oligonucleotide" and "polynucleotide" can be used interchangeably to refer to a polymer of nucleotides (e.g., a string of at least three nucleotides). In some embodiments, "nucleic acid" encompasses RNA as well as single and/or double-stranded DNA. Nucleic acids may be naturally occurring, for example, in the context of a genome, a transcript, an mRNA, tRNA, rRNA, siRNA, snRNA, a plasmid, cosmid, chromosome, chromatid, or other naturally occurring nucleic acid molecule. On the other hand, a nucleic acid molecule may be a non-naturally occurring molecule, e.g., a recombinant DNA or RNA, an artificial chromosome, an engineered genome, or fragment thereof, or a synthetic DNA, RNA, DNA/RNA hybrid, or including non-naturally occurring nucleotides or nucleosides. Furthermore, the terms "nucleic acid," "DNA," "RNA," and/or similar terms include nucleic acid analogs, i.e. analogs having other than a phosphodiester backbone. Nucleic acids can be purified from natural sources, produced using recombinant expression systems and optionally purified, chemically synthesized, etc. Where appropriate, e.g., in the case of chemically synthesized molecules, nucleic acids can comprise nucleoside analogs such as analogs having chemically modified bases or sugars, and backbone modifications' A nucleic acid sequence is presented in the 5' to 3' direction unless otherwise indicated. In some embodiments, a nucleic acid is or comprises natural nucleosides (e.g. adenosine, thymidine, guanosine, cytidine, uridine, deoxyadenosine, deoxythymidine, deoxyguanosine, and deoxycytidine); nucleoside analogs (e.g., 2-aminoadenosine, 2-thiothymidine, inosine, pyrrolo-pyrimidine, 3-methyl adenosine, 5-methylcytidine, 2-aminoadenosine, C5-bromouridine, C5-fluorouridine, C5-iodouridine, C5-propynyl-uridine, C5-propynyl-cytidine, C5-methylcytidine, 2-aminoadenosine, 7-deazaadenosine, 7-deazaguanosine, 8-oxoadenosine, 8-oxoguanosine, O(6)-methylguanine, and 2-thiocytidine); chemically modified bases; biologically modified bases (e.g., methylated bases); intercalated bases; modified sugars (e.g., 2'-fluororibose, ribose, 2'-deoxyribose, arabinose, and hexose); and/or modified phosphate groups (e.g., phosphorothioates and 5'-N-phosphoramidite linkages).

The term "pharmaceutical composition," as used herein, refers to a composition that can be administered to a subject in the context of treatment of a disease or disorder. In some embodiments, a pharmaceutical composition comprises an active ingredient, e.g. a nuclease or a nucleic acid encoding a nuclease, and a pharmaceutically acceptable excipient.

The term "proliferative disease," as used herein, refers to any disease in which cell or tissue homeostasis is disturbed in that a cell or cell population exhibits an abnormally elevated proliferation rate. Proliferative diseases include hyperproliferative diseases, such as pre-neoplastic hyperplastic conditions and neoplastic diseases. Neoplastic diseases are characterized by an abnormal proliferation of cells and include both benign and malignant neoplasias. Malignant neoplasia is also referred to a s cancer.

The terms "protein," "peptide," and "polypeptide" are used interchangeably herein, and refer to a polymer of amino acid residues linked together by peptide (amide) bonds. The terms refer to a protein, peptide, or polypeptide of any size, structure, or function. Typically, a protein, peptide, or polypeptide will be at least three amino acids long. A protein, peptide, or polypeptide may refer to an individual protein or a collection of proteins. One or more of the amino acids in a protein, peptide, or polypeptide may be modified, for example, by the addition of a chemical entity such as a carbohydrate group, a hydroxyl group, a phosphate group, a farnesyl group, an isofarnesyl group, a fatty acid group, a linker for conjugation, functionalization, or other modification, etc. A protein, peptide, or polypeptide may also be a single molecule or may be a multi-molecular complex. A protein, peptide, or polypeptide may be just a fragment of a naturally occurring protein or peptide. A protein, peptide, or polypeptide may be naturally occurring, recombinant, or synthetic, or any combination thereof. A protein may comprise different domains, for example, a nucleic acid binding domain and a nucleic acid cleavage domain. In some embodiments, a protein comprises a proteinaceous part, e.g., an amino acid sequence constituting a nucleic acid binding domain, and an organic compound, e.g., a compound that can act as a nucleic acid cleavage agent.

The term "randomized," as used herein in the context of nucleic acid sequences, refers to a sequence or residue within a sequence that has been synthesized to incorporate a mixture of free nucleotides, for example, a mixture of all four nucleotides A, T, G, and C. Randomized residues are typically represented by the letter N within a nucleotide sequence. In some embodiments, a randomized sequence or residue is fully randomized, in which case the randomized residues are synthesized by adding equal amounts of the nucleotides to be incorporated (e.g., 25% T, 25% A, 25% G, and 25% C) during the synthesis step of the respective sequence residue. In some embodiments, a randomized sequence or residue is partially randomized, in which case the randomized residues are synthesized by adding non-equal amounts of the nucleotides to be incorporated (e.g., 79% T, 7% A, 7% G, and 7% C) during the synthesis step of the respective sequence residue. Partial randomization allows for the generation of sequences that are templated on a given sequence, but have incorporated mutations at a desired frequency. E.g., if a known nuclease target site is used as a synthesis template, partial randomization in which at each step the nucleotide represented at the respective residue is added to the synthesis at 79%, and the other three nucleotides are added at 7% each, will result in a mixture of partially randomized target sites being synthesized, which still represent the consensus sequence of the original target site, but which differ from the original target site at each residue with a statistical frequency of 21% for each residue so synthesized (distributed binomially). In some embodiments, a partially randomized sequence differs from the consensus sequence by more than 5%, more than 10%, more than 15%, more than 20%, more than 25%, or more than 30% on average, distributed binomially. In some embodiments, a partially randomized sequence differs from the consensus site by no more than 10%, no more than 15%, no more than 20%, no more than 25%, nor more than 30%, no more than 40%, or no more than 50% on average, distributed binomially.

The terms "small molecule" and "organic compound" are used interchangeably herein and refer to molecules, whether naturally-occurring or artificially created (e.g., via chemical synthesis) that have a relatively low molecular weight. Typically, an organic compound contains carbon. An organic compound may contain multiple carbon-carbon bonds, stereocenters, and other functional groups (e.g., amines, hydroxyl, carbonyls, or heterocyclic rings). In some embodiments, organic compounds are monomeric and have a molecular weight of less than about 1500 g/mol. In certain embodiments, the molecular weight of the small molecule is less than about 1000 g/mol or less than about 500 g/mol. In certain embodiments, the small molecule is a drug, for example, a drug that has already been deemed safe and effective for use in humans or animals by the appropriate governmental agency or regulatory body. In certain embodiments, the organic molecule is known to bind and/or cleave a nucleic acid. In some embodiments, the organic compound is an enediyne. In some embodiments, the organic compound is an antibiotic drug, for example, an anticancer antibiotic such as dynemicin, neocarzinostatin, calicheamicin, esperamicin, bleomycin, or a derivative thereof.

The term "subject," as used herein, refers to an individual organism, for example, an individual mammal. In some embodiments, the subject is a human. In some embodiments, the subject is a non-human mammal. In some embodiments, the subject is a non-human primate. In some embodiments, the subject is a rodent. In some embodiments, the subject is a sheep, a goat, a cattle, a cat, or a dog. In some embodiments, the subject is a vertebrate, an amphibian, a reptile, a fish, an insect, a fly, or a nematode.

The terms "target nucleic acid," and "target genome," as used herein in the context of nucleases, refer to a nucleic acid molecule or a genome, respectively, that comprises at least one target site of a given nuclease.

The term "target site," used herein interchangeably with the term "nuclease target site," refers to a sequence within a nucleic acid molecule that is bound and cleaved by a nuclease. A target site may be single-stranded or double-stranded. In the context of nucleases that dimerize, for example, nucleases comprising a FokI DNA cleavage domain, a target sites typically comprises a left-half site (bound by one monomer of the nuclease), a right-half site (bound by the second monomer of the nuclease), and a spacer sequence between the half sites in which the cut is made. This structure ([left-half site]-[spacer sequence]-[right-half site]) is referred to herein as an LSR structure. In some embodiments, the left-half site and/or the right-half site is between 10-18 nucleotides long. In some embodiments, either or both half-sites are shorter or longer. In some embodiments, the left and right half sites comprise different nucleic acid sequences.

The term "Transcriptional Activator-Like Effector," (TALE) as used herein, refers to bacterial proteins comprising a DNA binding domain, which contains a highly conserved 33-34 amino acid sequence comprising a highly variable two-amino acid motif (Repeat Variable Diresidue, RVD). The RVD motif determines binding specificity to a nucleic acid sequence, and can be engineered according to methods well known to those of skill in the art to specifically bind a desired DNA sequence (see, e.g., Miller, Jeffrey; et. al. (February 2011). "A TALE nuclease architecture for efficient genome editing". Nature Biotechnology 29 (2): 143-8; Zhang, Feng; et. al. (February 2011). "Efficient construction of sequence-specific TAL effectors for modulating mammalian transcription". Nature Biotechnology 29 (2): 149-53; Geißler, R.; Scholze, H.; Hahn, S.; Streubel, J.; Bonas, U.; Behrens, S. E.; Boch, J. (2011), Shiu, Shin-Han. ed. "Transcriptional Activators of Human Genes with Programmable DNA-Specificity". PLoS ONE 6 (5): e19509; Boch, Jens (February 2011). "TALEs of genome targeting". Nature Biotechnology 29 (2): 135-6; Boch, Jens; et. al. (December 2009). "Breaking the Code of DNA Binding Specificity of TAL-Type III Effectors". Science 326 (5959): 1509-12; and Moscou, Matthew J.; Adam J. Bogdanove (December 2009). "A Simple Cipher Governs DNA Recognition by TAL Effectors". Science 326 (5959): 1501; the entire contents of each of which are incorporated herein by reference). The simple relationship between amino acid sequence and DNA recognition has allowed for the engineering of specific DNA binding domains by selecting a combination of repeat segments containing the appropriate RVDs.

The term "Transcriptional Activator-Like Element Nuclease," (TALEN) as used herein, refers to an artificial nuclease comprising a transcriptional activator like effector DNA binding domain to a DNA cleavage domain, for example, a FokI domain. A number of modular assembly schemes for generating engineered TALE constructs have been reported (Zhang, Feng; et. al. (February 2011). "Efficient construction of sequence-specific TAL effectors for modulating mammalian transcription". Nature Biotechnology 29 (2): 149-53; Geißler, R.; Scholze, H.; Hahn, S.; Streubel, J.; Bonas, U.; Behrens, S. E.; Boch, J. (2011), Shiu, Shin-Han. ed. "Transcriptional Activators of Human Genes with Programmable DNA-Specificity". PLoS ONE 6 (5): e19509; Cermak, T.; Doyle, E. L.; Christian, M.; Wang, L.; Zhang, Y.; Schmidt, C.; Baller, J. A.; Somia, N. V. et al. (2011). "Efficient design and assembly of custom TALEN and other TAL effector-based constructs for DNA targeting". Nucleic Acids Research; Morbitzer, R.; Elsaesser, J.; Hausner, J.; Lahaye, T. (2011). "Assembly of custom TALE-type DNA binding domains by modular cloning". Nucleic Acids Research; Li, T.; Huang, S.; Zhao, X.; Wright, D. A.; Carpenter, S.; Spalding, M. H.; Weeks, D. P.; Yang, B. (2011). "Modularly assembled designer TAL effector nucleases for targeted gene knockout and gene replacement in eukaryotes". Nucleic Acids Research.; Weber, E.; Gruetzner, R.; Werner, S.; Engler, C.; Marillonnet, S. (2011). Bendahmane, Mohammed. ed. "Assembly of Designer TAL Effectors by Golden Gate Cloning". PLoS ONE 6 (5): e19722; the entire contents of each of which are incorporated herein by reference).

The terms "treatment," "treat," and "treating," refer to a clinical intervention aimed to reverse, alleviate, delay the onset of, or inhibit the progress of a disease or disorder, or one or more symptoms thereof, as described herein. As used herein, the terms "treatment," "treat," and "treating" refer to a clinical intervention aimed to reverse, alleviate, delay the onset of, or inhibit the progress of a disease or disorder, or one or more symptoms thereof, as described herein. In some embodiments, treatment may be administered after one or more symptoms have developed and/or after a disease has been diagnosed. In other embodiments, treatment may be administered in the absence of symptoms, e.g., to prevent or delay onset of a symptom or inhibit onset or progression of a disease. For example, treatment may be administered to a susceptible individual prior to the onset of symptoms (e.g., in light of a history of symptoms and/or in light of genetic or other susceptibility factors). Treatment may also be continued after symptoms have resolved, for example to prevent or delay their recurrence.

The term "zinc finger," as used herein, refers to a small nucleic acid-binding protein structural motif characterized by a fold and the coordination of one or more zinc ions that stabilize the fold. Zinc fingers encompass a wide variety of differing protein structures (see, e.g., Klug A, Rhodes D (1987). "Zinc fingers: a novel protein fold for nucleic acid recognition". Cold Spring Harb. Symp. Quant. Biol. 52: 473-

82, the entire contents of which are incorporated herein by reference). Zinc fingers can be designed to bind a specific sequence of nucleotides, and zinc finger arrays comprising fusions of a series of zinc fingers, can be designed to bind virtually any desired target sequence. Such zinc finger arrays can form a binding domain of a protein, for example, of a nuclease, e.g., if conjugated to a nucleic acid cleavage domain. Different type of zinc finger motifs are known to those of skill in the art, including, but not limited to, $Cys_2His_2$, Gag knuckle, Treble clef, Zinc ribbon, $Zn_2/Cys_6$, and TAZ2 domain-like motifs (see, e.g., Krishna S S, Majumdar I, Grishin N V (January 2003). "Structural classification of zinc fingers: survey and summary". *Nucleic Acids Res*. 31 (2): 532-50). Typically, a single zinc finger motif binds 3 or 4 nucleotides of a nucleic acid molecule. Accordingly, a zinc finger domain comprising 2 zinc finger motifs may bind 6-8 nucleotides, a zinc finger domain comprising 3 zinc finger motifs may bind 9-12 nucleotides, a zinc finger domain comprising 4 zinc finger motifs may bind 12-16 nucleotides, and so forth. Any suitable protein engineering technique can be employed to alter the DNA-binding specificity of zinc fingers and/or design novel zinc finger fusions to bind virtually any desired target sequence from 3-30 nucleotides in length (see, e.g., Pabo C O, Peisach E, Grant R A (2001). "Design and selection of novel cys2His2 Zinc finger proteins". *Annual Review of Biochemistry* 70: 313-340; Jamieson A C, Miller J C, Pabo C O (2003). "Drug discovery with engineered zinc-finger proteins". *Nature Reviews Drug Discovery* 2 (5): 361-368; and Liu Q, Segal D J, Ghiara J B, Barbas C F (May 1997). "Design of polydactyl zinc-finger proteins for unique addressing within complex genomes". *Proc. Natl. Acad. Sci. U.S.A.* 94 (11); the entire contents of each of which are incorporated herein by reference). Fusions between engineered zinc finger arrays and protein domains that cleave a nucleic acid can be used to generate a "zinc finger nuclease." A zinc finger nuclease typically comprises a zinc finger domain that binds a specific target site within a nucleic acid molecule, and a nucleic acid cleavage domain that cuts the nucleic acid molecule within or in proximity to the target site bound by the binding domain. Typical engineered zinc finger nucleases comprise a binding domain having between 3 and 6 individual zinc finger motifs and binding target sites ranging from 9 base pairs to 18 base pairs in length. Longer target sites are particularly attractive in situations where it is desired to bind and cleave a target site that is unique in a given genome.

The term "zinc finger nuclease," as used herein, refers to a nuclease comprising a nucleic acid cleavage domain conjugated to a binding domain that comprises a zinc finger array. In some embodiments, the cleavage domain is the cleavage domain of the type II restriction endonuclease FokI. Zinc finger nucleases can be designed to target virtually any desired sequence in a given nucleic acid molecule for cleavage, and the possibility to the design zinc finger binding domains to bind unique sites in the context of complex genomes allows for targeted cleavage of a single genomic site in living cells, for example, to achieve a targeted genomic alteration of therapeutic value. Targeting a double-strand break to a desired genomic locus can be used to introduce frame-shift mutations into the coding sequence of a gene due to the error-prone nature of the non-homologous DNA repair pathway. Zinc finger nucleases can be generated to target a site of interest by methods well known to those of skill in the art. For example, zinc finger binding domains with a desired specificity can be designed by combining individual zinc finger motifs of known specificity. The structure of the zinc finger protein Zif268 bound to DNA has informed much of the work in this field and the concept of obtaining zinc fingers for each of the 64 possible base pair triplets and then mixing and matching these modular zinc fingers to design proteins with any desired sequence specificity has been described (Pavletich N P, Pabo C O (May 1991). "Zinc finger-DNA recognition: crystal structure of a Zif268-DNA complex at 2.1 Å". *Science* 252 (5007): 809-17, the entire contents of which are incorporated herein). In some embodiments, separate zinc fingers that each recognize a 3 base pair DNA sequence are combined to generate 3-, 4-, 5-, or 6-finger arrays that recognize target sites ranging from 9 base pairs to 18 base pairs in length. In some embodiments, longer arrays are contemplated. In other embodiments, 2-finger modules recognizing 6-8 nucleotides are combined to generate 4-, 6-, or 8-zinc finger arrays. In some embodiments, bacterial or phage display is employed to develop a zinc finger domain that recognizes a desired nucleic acid sequence, for example, a desired nuclease target site of 3-30 bp in length. Zinc finger nucleases, in some embodiments, comprise a zinc finger binding domain and a cleavage domain fused or otherwise conjugated to each other via a linker, for example, a polypeptide linker. The length of the linker determines the distance of the cut from the nucleic acid sequence bound by the zinc finger domain. If a shorter linker is used, the cleavage domain will cut the nucleic acid closer to the bound nucleic acid sequence, while a longer linker will result in a greater distance between the cut and the bound nucleic acid sequence. In some embodiments, the cleavage domain of a zinc finger nuclease has to dimerize in order to cut a bound nucleic acid. In some such embodiments, the dimer is a heterodimer of two monomers, each of which comprise a different zinc finger binding domain. For example, in some embodiments, the dimer may comprise one monomer comprising zinc finger domain A conjugated to a FokI cleavage domain, and one monomer comprising zinc finger domain B conjugated to a FokI cleavage domain. In this nonlimiting example, zinc finger domain A binds a nucleic acid sequence on one side of the target site, zinc finger domain B binds a nucleic acid sequence on the other side of the target site, and the dimerize FokI domain cuts the nucleic acid in between the zinc finger domain binding sites.

DETAILED DESCRIPTION OF CERTAIN EMBODIMENTS OF THE INVENTION

Introduction

Site-specific nucleases are powerful tools for the targeted modification of a genome. Some site specific nucleases can theoretically achieve a level of specificity for a target cleavage site that would allow to target a single unique site in a genome for cleaveage without affecting any other genomic site. It has been reported that nuclease cleavage in living cells triggers a DNA repair mechanism that frequently results in a modification of the cleaved, repaired genomic sequence, for example, via homologous recombination. Accordingly, the targeted cleavage of a specific unique sequence within a genome opens up new avenues for gene targeting and gene modification in living cells, including cells that are hard to manipulate with conventional gene targeting methods, such as many human somatic or embryonic stem cells. Nuclease-mediated modification of disease-related sequences, e.g., the CCR-5 allele in HIV/AIDS patients, or of genes necessary for tumor neovascularization, can be used in the clinical context, and two site specific nucleases are currently in clinical trials.

One important aspect in the field of site-specific nuclease-mediated modification are off-target nuclease effects, e.g., the cleavage of genomic sequences that differ from the intended target sequence by one or more nucleotides. Undesired side effects of off-target cleavage ranges from insertion into unwanted loci during a gene targeting event to severe complications in a clinical scenario. Off target cleavage of sequences encoding essential gene functions or tumor suppressor genes by an andonuclease administered to a subject may result in disease or even death of the subject. Accordingly, it is desirable to characterize the cleavage preferences of a nuclease before using it in the laboratory or the clinic in order to determine its efficacy and safety. Further, the characterization of nuclease cleavager properties allows for the selection of the nuclease best suited for a specific task from a group of candidate nucleases, or for the selection of evolution products obtained from existing nucleases. Such a characterization of nuclease cleavage properties may also inform the de-novo design of nucleases with enhanced properties, such as enhanced specificity or efficiency.

In many scenarios where a nuclease is employed for the targeted manipulation of a nucleic acid, cleavage specificity is a crucial feature. The imperfect specificity of some engineered nuclease binding domains can lead to off-target cleavage and undesired effects both in vitro and in vivo. Current methods of evaluating site-specific nuclease specificity, including ELISA assays, microarrays, one-hybrid systems, SELEX and its variants, and Rosetta-based computational predictions, are all premised on the assumption that the binding specificity of nuclease molecules is equivalent or proportionate to their cleavage specificity.

However, the work presented here is based on the discovery that prediction of nuclease off-target binding effects constitutes an imperfect approximation of a nuclease's off-target cleavage effects that may result in undesired biological effects. This finding is consistent with the notion that the reported toxicity of some site specific DNA nucleases results from off-target DNA cleavage, rather than off-target binding alone.

The methods and reagents provided herein allow for an accurate evaluation of a given nuclease's target site specificity and provide strategies for the selection of suitable unique target sites and the design of highly specific nucleases for the targeted cleavage of a single site in the context of a complex genome. Further, methods, reagents, and strategies provided herein allow those of skill to enhance the specificity and minimize the off-target effects of any given site-specific nuclease. While of particular relevance to DNA and DNA-cleaving nucleases, the inventive concepts, methods, strategies, and reagents provided herein are not limited in this respect, but can be applied to any nucleic acid:nuclease pair.

Identifying Nuclease Target Sites Cleaved by a Site-specific Nuclease

Some aspects of this invention provide methods and reagents to determine the nucleic acid target sites cleaved by any site-specific nuclease. In general, such methods comprise contacting a given nuclease with a library of target sites under conditions suitable for the nuclease to bind and cut a target site, and determining which target sites the nuclease actually cuts. A determination of a nuclease's target site profile based on actual cutting has the advantage over methods that rely on binding that it measures a parameter more relevant for mediating undesired off-target effects of site-specific nucleases.

In some embodiments, a method for identifying a target site of a nuclease is provided. In some embodiments, the method comprises (a) providing a nuclease that cuts a double-stranded nucleic acid target site and creates a 5' overhang, wherein the target site comprises a [left-half site]-[spacer sequence]-[right-half site] (LSR) structure, and the nuclease cuts the target site within the spacer sequence. In some embodiments, the method comprises (b) contacting the nuclease with a library of candidate nucleic acid molecules, wherein each nucleic acid molecule comprises a concatemer of a sequence comprising a candidate nuclease target site and a constant insert sequence, under conditions suitable for the nuclease to cut a candidate nucleic acid molecule comprising a target site of the nuclease. In some embodiments, the method comprises (c) filling in the 5' overhangs of a nucleic acid molecule that has been cut twice by the nuclease and comprises a constant insert sequence flanked by a left half-site and cut spacer sequence on one side, and a right half-site and cut spacer sequence on the other side, thereby creating blunt ends. In some embodiments, the method comprises (d) identifying the nuclease target site cut by the nuclease by determining the sequence of the left-half site, the right-half-site, and/or the spacer sequence of the nucleic acid molecule of step (c). In some embodiments, the method comprises providing a nuclease and contacting the nuclease with a library of candidate nucleic acid molecules comprising candidate target sites. In some embodiments, the candidate nucleic acid molecules are double-stranded nucleic acid molecules. In some embodiments, the candidate nucleic acid molecules are DNA molecules. In some embodiments, the nuclease dimerizes at the target site, and the target site comprises an LSR structure ([left-half site]-[spacer sequence]-[right-half site]). In some embodiments, the nuclease cuts the target site within the spacer sequence. In some embodiments, the nuclease is a nuclease that cuts a double-stranded nucleic acid target site and creates a 5' overhang. In some embodiments, each nucleic acid molecule in the library comprises a concatemer of a sequence comprising a candidate nuclease target site and a constant insert sequence.

For example, in some embodiments, the candidate nucleic acid molecules of the library comprise the structure $R_1$-$[(LSR)\text{-(constant region)}]_x$-$R_2$, wherein R1 and R2 are, independently, nucleic acid sequences that may comprise a fragment of the [(LSR)-(constant region)] repeat unit, and X is an integer between 2 and y. In some embodiments, y is at least $10^1$, at least $10^2$, at least $10^3$, at least $10^4$, at least $10^5$, at least $10^6$, at least $10^7$, at least $10^8$, at least $10^9$, at least $10^{10}$, at least $10^{11}$, at least $10^{12}$, at least $10^{13}$, at least $10^{14}$, or at least $10^{15}$. In some embodiments, y is less than $10^2$, less than $10^3$, less than $10^4$, less than $10^5$, less than $10^6$, less than $10^7$, less than $10^8$, less than $10^9$, less than $10^{10}$, less than $10^{11}$, less than $10^{12}$, less than $10^{13}$, less than $10^{14}$, or less than $10^{15}$. The constant region, in some embodiments, is of a length that allows for efficient self ligation of a single repeat unit. Suitable lengths will be apparent to those of skill in the art. For example, in some embodiments, the constant region is between 100 and 1000 base pairs long, for example, about 100 base pairs, about 200 base pairs, about 300 base pairs, about 400 base pairs, about 450 base pairs, about 500 base pairs, about 600 base pairs, about 700 base pairs, about 800 base pairs, about 900 base pairs, or about 1000 base pairs long in some embodiments, the constant region is shorter than about 100 base pairs or longer than about 1000 base pairs.

Incubation of the nuclease with the library nucleic acids will result in cleavage of those concatemers in the library that comprise target sites that can be bound and cleaved by the nuclease. If a given nuclease cleaves a specific target site with high efficiency, a concatemer comprising target sites will be cut multiple times, resulting in the generation of fragments comprising a single repeat unit. The repeat unit released from the concatemer by nuclease cleavage will be of the structure $S_2R$-(constant region)-$LS_1$, wherein $S_1$ and $S_2$ represent complementary spacer region fragments after being cut by the nuclease. Any repeat units released from library candidate molecules can then be isolated and/or the sequence of the LSR cleaved by the nuclease identified by sequencing the $S_2R$ and $LS_1$ regions of released repeat units.

Any method suitable for isolation and sequencing of the repeat units can be employed to elucidate the LSR sequence cleaved by the nuclease. For example, since the length of the constant region is known, individual released repeat units can be separated based on their size from the larger uncut library nucleic acid molecules as well as from fragments of library nucleic acid molecules that comprise multiple repeat units (indicating non-efficient targeted cleavage by the nuclease). Suitable methods for separating and/or isolating nucleic acid molecules based on their size a well-known to those of skill in the art and include, for example, size fractionation methods, such as gel electrophoresis, density gradient centrifugation, and dialysis over a semi-permeable membrane with a suitable molecular cutoff value. The separated/isolated nucleic acid molecules can then be further characterized, for example, by ligating PCR and/or sequencing adapters to the cut ends and amplifying and/or sequencing the respective nucleic acids. Further, if the length of the constant region is selected to favor self-ligation of individual released repeat units, such individual released repeat units may be enriched by contacting the nuclease treated library molecules with a ligase and subsequent amplification and/or sequencing based on the circularized nature of the self-ligated individual repeat units.

In some embodiments, where a nuclease is used that generates 5' overhangs as a result of cutting a target nucleic acid, the 5' overhangs of the cut nucleic acid molecules are filled in. Methods for filling in 5' overhangs are well known to those of skill in the art and include, for example, methods using DNA polymerase I Klenow fragment lacking exonuclease activity (Klenow (3'->5' exo-)). Filling in 5' overhangs results in the overhang-templated extension of the recessed strand, which, in turn, results in blunt ends. In the case of single repeat units released from library concatemers, the resulting structure is a blunt-ended $S_2$'R-(constant region)-$LS_1$', with $S_1$' and $S_2$' comprising blunt ends. PCR and/or sequencing adapters can then be added to the ends by blunt end ligation and the respective repeat units (including $S_2$'R and $LS_1$' regions) can be sequenced. From the sequence data, the original LSR region can be deducted. Blunting of the overhangs created during the nuclease cleavage process also allows for distinguishing between target sites that were properly cut by the respective nuclease and target sites that were non-specifically cut e.g., based on non-nuclease effects such as physical shearing. Correctly cleaved nuclease target sites can be recognized by the existence of complementary $S_2$'R and $LS_1$' regions, which comprise a duplication of the overhang nucleotides as a result of the overhang fill in, while target sites that were not cleaved by the respective nuclease are unlikely to comprise overhang nucleotide duplications. In some embodiments, the method comprises identifying the nuclease target site cut by the nuclease by determining the sequence of the left-half site, the right-half-site, and/or the spacer sequence of a released individual repeat unit. Any suitable method for amplifying and/or sequencing can be used to identify the LSR sequence of the target site cleaved by the respective nuclease. Methods for amplifying and/or sequencing nucleic acid molecules are well known to those of skill in the art and the invention is not limited in this respect.

Some of the methods and strategies provided herein allow for the simultaneous assessment of a plurality of candidate target sites as possible cleavage targets for any given nuclease. Accordingly, the data obtained from such methods can be used to compile a list of target sites cleaved by a given nuclease, which is also referred to herein as a target site profile. If they sequencing method is used that allows for the generation of quantitative sequencing data, it is also possible to record the relative abundance of any nuclease target site detected to be cleaved by the respective nuclease. Target sites that are cleaved more efficiently by the nuclease will be detected more frequently in the sequencing step, while target sites that are not cleaved efficiently will only rarely release an individual repeat unit from a candidate concatemer, and thus, will only generate few, if any sequencing reads. Such quantitative sequencing data can be integrated into a target site profile to generate a ranked list of highly preferred and less preferred nuclease target sites.

The methods and strategies of nuclease target site profiling provided herein can be applied to any site-specific nuclease, including, for example, ZFNs, TALENs, and homing endonucleases. As described in more detail herein, nuclease specificity typically decreases with increasing nuclease concentration, and the methods described herein can be used to determine a concentration at which a given nuclease efficiently cuts its intended target site, but does not efficiently cut any off target sequences. In some embodiments, a maximum concentration of a therapeutic nuclease is determined at which the therapeutic nuclease cuts its intended nuclease target site, but does not cut more than 10, more than 5, more than 4, more than 3, more than 2, more than 1, or any additional nuclease target sites. In some embodiments, a therapeutic nuclease is administered to a subject in an amount effective to generate a final concentration equal or lower to the maximum concentration determined as described above.

Nuclease Target Site Libraries

Some embodiments of this invention provide libraries of nucleic acid molecules for nuclease target site profiling. In some embodiments such a library comprises a plurality of nucleic acid molecules, each comprising a concatemer of a candidate nuclease target site and a constant insert sequence spacer sequence. For example, in some embodiments, the candidate nucleic acid molecules of the library comprise the structure $R_1$-[(LSR)-(constant region)]$_X$-$R_2$, wherein R1 and R2 are, independently, nucleic acid sequences that may comprise a fragment of the [(LSR)-(constant region)] repeat unit, and X is an integer between 2 and y. In some embodiments, y is at least $10^1$, at least $10^2$, at least $10^3$, at least $10^4$, at least $10^5$, at least $10^6$, at least $10^7$, at least $10^8$, at least $10^9$, at least $10^{10}$, at least $10^{11}$, at least $10^{12}$, at least $10^{13}$, at least $10^{14}$, or at least $10^{15}$. In some embodiments, y is less than $10^2$, less than $10^3$, less than $10^4$, less than $10^5$, less than $10^6$, less than $10^7$, less than $10^8$, less than $10^9$, less than $10^{10}$, less than $10^{11}$, less than $10^{12}$, less than $10^{13}$, less than $10^{14}$, or less than $10^{15}$. The constant region, in some embodiments, is of a length that allows for efficient self ligation of a single repeat unit. In some embodiments, the constant region is of a length that allows for efficient separation of single repeat units from fragments comprising two or more repeat units. In some embodiments, the concentration is over length allows for efficient sequencing of a complete repeat unit in one sequencing read. Suitable lengths will be apparent to those of skill in the art. For example, in some embodiments, the constant region is between 100 and 1000 base pairs long, for example, about 100 base pairs, about 200 base pairs, about 300 base pairs, about 400 base pairs, about 450 base pairs, about 500 base pairs, about 600 base pairs, about 700 base pairs, about 800 base pairs, about 900 base pairs, or about 1000 base pairs long in some embodiments, the constant region is shorter than about 100 base pairs or longer than about 1000 base pairs.

An LSR site typically comprises a [left-half site]-[spacer sequence]-[right-half site] structure. The lengths of the half-size and the spacer sequence will depend on the specific nuclease to be evaluated. In general, the half-sites will be 6-30 nucleotides long, and preferably 10-18 nucleotides long. For example, each half site individually may be 6, 7, 8, 9, 10, 11, 12, 13, 14, 15, 16, 17, 18, 19, 20, 21, 22, 23, 24, 25, 26, 27, 28, 29, or 30 nucleotides long. In some embodiments, an LSR site may be longer than 30 nucleotides. In some embodiments, the left half site and the right half site of an LSR are of the same length. In some embodiments, the left half site and the right half site of an LSR are of different lengths. In some embodiments, the left half site and the right half site of an LSR are of different sequences. In some embodiments, a library is provided that comprises candidate nucleic acids which comprise LSRs that can be cleaved by a FokI cleavage domain, a Zinc Finger Nuclease (ZFN), a Transcription Activator-Like Effector Nuclease (TALEN), a homing endonuclease, an organic compound nuclease, an enediyne, an antibiotic nuclease, dynemicin, neocarzinostatin, calicheamicin, esperamicin, and/or bleomycin.

In some embodiments, a library of candidate nucleic acid molecules is provided that comprises at least $10^5$, at least $10^6$, at least $10^7$, at least $10^8$, at least $10^9$, at least $10^{10}$, at least $10^{11}$, or at least $10^{12}$ different candidate nuclease target sites. In some embodiments, the candidate nucleic acid molecules of the library are concatemers produced from a secularized templates by rolling cycle amplification. In some embodiments, the library comprises nucleic acid molecules, e.g., concatemers, of a molecular weight of at least 5 kDa, at least 6 kDa, at least 7 kDa, at least 8 kDa, at least 9 kDa, at least 10 kDa, at least 12 kDa, or at least 15 kDa. in some embodiments, the molecular weight of the nucleic acid molecules within the library may be larger than 15 kDa. In some embodiments, the library comprises nucleic acid molecules within a specific size range, for example, within a range of 5-7 kDa, 5-10 kDa, 8-12 kDa, 10-15 kDa, or 12-15 kDa, or 5-10 kDa or any possible subrange. While some methods suitable for generating nucleic acid concatemers according to some aspects of this invention result in the generation of nucleic acid molecules of greatly different molecular weights, such mixtures of nucleic acid molecules may be size fractionated to obtain a desired size distribution. Suitable methods for enriching nucleic acid molecules of a desired size or excluding nucleic acid molecules of a desired size are well known to those of skill in the art and the invention is not limited in this respect.

In some embodiments, a library is provided comprising candidate nucleic acid molecules that comprise target sites with a partially randomized left-half site, a partially randomized right-half site, and/or a partially randomized spacer sequence. In some embodiments, the library is provided comprising candidate nucleic acid molecules that comprise target sites with a partially randomized left half site, a fully randomized spacer sequence, and a partially randomized right half site. In some embodiments, partially randomized sites differ from the consensus site by more than 5%, more than 10%, more than 15%, more than 20%, more than 25%, or more than 30% on average, distributed binomially. In some embodiments, partially randomized sites differ from the consensus site by no more than 10%, no more than 15%, no more than 20%, no more than 25%, nor more than 30%, no more than 40%, or no more than 50% on average, distributed binomially. For example, in some embodiments partially randomized sites differ from the consensus site by more than 5%, but by no more than 10%; by more than 10%, but by no more than 20%; by more than 20%, but by no more than 25%; by more than 5%, but by no more than 20%, and so on. Using partially randomized nuclease target sites in the library is useful to increase the concentration of library members comprising target sites that are closely related to the consensus site, for example, that differ from the consensus sites in only one, only two, only three, only four, or only five residues. The rationale behind this is that a given nuclease, for example a given ZFN, is likely to cut its intended target site and any closely related target sites, but unlikely to cut a target sites that is vastly different from or completely unrelated to the intended target site. Accordingly, using a library comprising partially randomized target sites can be more efficient than using libraries comprising fully randomized target sites without compromising the sensitivity in detecting any off target cleavage events for any given nuclease. Thus, the use of partially randomized libraries significantly reduces the cost and effort required to produce a library having a high likelihood of covering virtually all off target sites of a given nuclease. In some embodiments however it may be desirable to use a fully randomized library of target sites, for example, in embodiments, where the specificity of a given nuclease is to be evaluated in the context of any possible site in a given genome.

Selection and Design of Site-specific Nucleases

Some aspects of this invention provide methods and strategies for selecting and designing site-specific nucleases that allow the targeted cleavage of a single, unique sites in the context of a complex genome. In some embodiments, a method is provided that comprises providing a plurality of candidate nucleases that are designed or known to cut the same consensus sequence; profiling the target sites actually cleaved by each candidate nuclease, thus detecting any cleaved off-target sites (target sites that differ from the consensus target site); and selecting a candidate nuclease based on the off-target site(s) so identified. In some embodiments, this method is used to select the most specific nuclease from a group of candidate nucleases, for example, the nuclease that cleaves the consensus target site with the highest specificity, the nuclease that cleaves the lowest number of off-target sites, the nuclease that cleaves the lowest number of off-target sites in the context of a target genome, or a nuclease that does not cleave any target site other than the consensus target site. In some embodiments, this method is used to select a nuclease that does not cleave any off-target site in the context of the genome of a subject at concentration that is equal to or higher than a therapeutically effective concentration of the nuclease.

The methods and reagents provided herein can be used, for example, to evaluate a plurality of different nucleases targeting the same intended targets site, for example, a plurality of variations of a given site-specific nuclease, for example a given zinc finger nuclease. Accordingly, such methods may be used as the selection step in evolving or designing a novel site-specific nucleases with improved specificity.

Identifying Unique Nuclease Target Sites within a Genome

Some embodiments of this invention provide a method for selecting a nuclease target site within a genome. As described in more detail elsewhere herein, it was surprisingly discovered that off target sites cleaved by a given nuclease are typically highly similar to the consensus target site, e.g., differing from the consensus target site in only one, only two, only three, only four, or only five nucleotide residues. Based on this discovery, a nuclease target sites within the genome can be selected to increase the likelihood of a nuclease targeting this site not cleaving any off target sites within the genome. For example, in some embodiments, a method is provided that comprises identifying a candidate nuclease target site; and comparing the candidate nuclease target site to other sequences within the genome. Methods for comparing candidate nuclease target sites to other sequences within the genome are well known to those of skill in the art and include for example sequence alignment methods, for example, using a sequence alignment software or algorithm such as BLAST on a general purpose computer. A suitable unique nuclease target site can then be selected based on the results of the sequence comparison. In some embodiments, if the candidate nuclease target site differs from any other sequence within the genome by at least 3, at least 4, at least 5, at least 6, at least 7, at least 8, at least 9, or at least 10 nucleotides, the nuclease target site is selected as a unique site within the genome, whereas if the site does not fulfill this criteria, the site may be discarded. In some embodiments, once a site is selected based on the sequence comparison, as outlined above, a site-specific nuclease targeting the selected site is designed. For example, a zinc finger nuclease may be designed to target any selected nuclease target site by constructing a zinc finger array binding the target site, and conjugating the zinc finger array to a DNA cleavage domain. In embodiments where the DNA cleavage domain needs to dimerize in order to cleave DNA, to zinc finger arrays will be designed, each binding a half site of the nuclease target site, and each conjugated to a cleavage domain. In some embodiments, nuclease designing and/or generating is done by recombinant technology. Suitable recombinant technologies are well known to those of skill in the art, and the invention is not limited in this respect.

In some embodiments, a site-specific nuclease designed or generated according to aspects of this invention is isolated and/or purified. The methods and strategies for designing site-specific nucleases according to aspects of this invention can be applied to design or generate any site-specific nuclease, including, but not limited to Zinc Finger Nucleases, Transcription Activator-Like Effector Nucleases (TALENs), homing endonucleases, organic compound nucleases, enediyne nucleases, antibiotic nucleases, and dynemicin, neocarzinostatin, calicheamicin, esperamicin, bleomycin, or a derivative thereof variants or derivatives.

Site-specific Nucleases

Some aspects of this invention provide isolated site-specific nucleases with enhanced specificity that are designed using the methods and strategies described herein. Some embodiments, of this invention provide nucleic acids encoding such nucleases. Some embodiments of this invention provide expression constructs comprising such encoding nucleic acids. For example, in some embodiments an isolated nuclease is provided that has been engineered to cleave a desired target site within a genome, and has been evaluated according to a method provided herein to cut less than 1, less than 2, less than 3, less than 4, less than 5, less than 6, less than 7, less than 8, less than 9 or less than 10 off-target sites at a concentration effective for the nuclease to cut its intended target site. In some embodiments an isolated nuclease is provided that has been engineered to cleave a desired unique target site that has been selected to differ from any other site within a genome by at least 3, at least 4, at least 5, at least 6, at least 7, at least 8, at least 9, or at least 10 nucleotide residues. In some embodiments, the isolated nuclease is a Zinc Finger Nuclease (ZFN) or a Transcription Activator-Like Effector Nuclease (TALEN), a homing endonuclease, or is or comprises an organic compound nuclease, an enediyne, an antibiotic nuclease, dynemicin, neocarzinostatin, calicheamicin, esperamicin, bleomycin, or a derivative thereof. In some embodiments, the isolated nuclease cleaves a consensus target site within an allele that is associated with a disease or disorder. In some embodiments, the isolated nuclease cleaves a consensus target site the cleavage of which results in treatment or prevention of a disease or disorder. In some embodiments, the disease is HIV/AIDS, or a proliferative disease. In some embodiments, the allele is a CCR5 (for treating HIV/AIDS) or a VEGFA allele (for treating a proliferative disease).

In some embodiments, the isolated nuclease is provided as part of a pharmaceutical composition. For example, some embodiments provide pharmaceutical compositions comprising a nuclease as provided herein, or a nucleic acid encoding such a nuclease, and a pharmaceutically acceptable excipient. Pharmaceutical compositions may optionally comprise one or more additional therapeutically active substances.

In some embodiments, compositions provided herein are administered to a subject, for example, to a human subject, in order to effect a targeted genomic modification within the subject. In some embodiments, cells are obtained from the subject and contacted with a nuclease or a nuclease-encoding nucleic acid ex vivo, and re-administered to the subject after the desired genomic modification has been effected or detected in the cells. Although the descriptions of pharmaceutical compositions provided herein are principally directed to pharmaceutical compositions which are suitable for administration to humans, it will be understood by the skilled artisan that such compositions are generally suitable for administration to animals of all sorts. Modification of pharmaceutical compositions suitable for administration to humans in order to render the compositions suitable for administration to various animals is well understood, and the ordinarily skilled veterinary pharmacologist can design and/or perform such modification with merely ordinary, if any, experimentation. Subjects to which administration of the pharmaceutical compositions is contemplated include, but are not limited to, humans and/or other primates; mammals, including commercially relevant mammals such as cattle, pigs, horses, sheep, cats, dogs, mice, and/or rats; and/or birds, including commercially relevant birds such as chickens, ducks, geese, and/or turkeys.

Formulations of the pharmaceutical compositions described herein may be prepared by any method known or hereafter developed in the art of pharmacology. In general, such preparatory methods include the step of bringing the active ingredient into association with an excipient and/or one or more other accessory ingredients, and then, if necessary and/or desirable, shaping and/or packaging the product into a desired single- or multi-dose unit.

Pharmaceutical formulations may additionally comprise a pharmaceutically acceptable excipient, which, as used herein, includes any and all solvents, dispersion media, diluents, or other liquid vehicles, dispersion or suspension aids, surface active agents, isotonic agents, thickening or emulsifying agents, preservatives, solid binders, lubricants and the like, as suited to the particular dosage form desired. Remington's *The Science and Practice of Pharmacy*, 21$^{st}$ Edition, A. R. Gennaro (Lippincott, Williams & Wilkins, Baltimore, Md., 2006; incorporated herein by reference) discloses various excipients used in formulating pharmaceutical compositions and known techniques for the preparation thereof. Except insofar as any conventional excipient medium is incompatible with a substance or its derivatives, such as by producing any undesirable biological effect or otherwise interacting in a deleterious manner with any other component(s) of the pharmaceutical composition, its use is contemplated to be within the scope of this invention.

The function and advantage of these and other embodiments of the present invention will be more fully understood from the Examples below. The following Examples are intended to illustrate the benefits of the present invention and to describe particular embodiments, but are not intended to exemplify the full scope of the invention. Accordingly, it will be understood that the Examples are not meant to limit the scope of the invention.

EXAMPLES

Example 1

Zinc Finger Nucleases

Introduction

Zinc finger nucleases (ZFNs) are enzymes engineered to recognize and cleave desired target DNA sequences. A ZFN monomer consists of a zinc finger DNA-binding domain fused with a non-specific FokI restriction endonuclease cleavage domain[1]. Since the FokI nuclease domain must dimerize and bridge two DNA half-sites to cleave DNA[2], ZFNs are designed to recognize two unique sequences flanking a spacer sequence of variable length and to cleave only when bound as a dimer to DNA. ZFNs have been used for genome engineering in a variety of organisms including mammals[3-9] by stimulating either non-homologous end joining or homologous recombination. In addition to providing powerful research tools, ZFNs also have potential as gene therapy agents. Indeed, two ZFNs have recently entered clinical trials: one as part of an anti-HIV therapeutic approach (NCT00842634, NCT01044654, NCT01252641) and the other to modify cells used as anti-cancer therapeutics (NCT01082926).

DNA cleavage specificity is a crucial feature of ZFNs. The imperfect specificity of some engineered zinc fingers domains has been linked to cellular toxicity[10] and therefore determining the specificities of ZFNs is of significant interest. ELISA assays[11], microarrays[12], a bacterial one-hybrid system[13], SELEX and its variants[14-16], and Rosetta-based computational predictions[17] have all been used to characterize the DNA-binding specificity of monomeric zinc finger domains in isolation. However, the toxicity of ZFNs is believed to result from DNA cleavage, rather than binding alone[18,19]. As a result, information about the specificity of zinc finger nucleases to date has been based on the unproven assumptions that (i) dimeric zinc finger nucleases cleave DNA with the same sequence specificity with which isolated monomeric zinc finger domains bind DNA; and (ii) the binding of one zinc finger domain does not influence the binding of the other zinc finger domain in a given ZFN. The DNA-binding specificities of monomeric zinc finger domains have been used to predict potential off-target cleavage sites of dimeric ZFNs in genomes[6,20], but to our knowledge no study to date has reported a method for determining the broad DNA cleavage specificity of active, dimeric zinc finger nucleases.

In this work we present an in vitro selection method to broadly examine the DNA cleavage specificity of active ZFNs. Our selection was coupled with high-throughput DNA sequencing technology to evaluate two obligate heterodimeric ZFNs, CCR5-224[6], currently in clinical trials (NCT00842634, NCT01044654, NCT01252641), and VF2468[4], that targets the human VEGF-A promoter, for their abilities to cleave each of $10^{11}$ potential target sites. We identified 37 sites present in the human genome that can be cleaved in vitro by CCR5-224, 2,652 sites in the human genome that can be cleaved in vitro by VF2468, and hundreds of thousands of in vitro cleavable sites for both ZFNs that are not present in the human genome. To demonstrate that sites identified by our in vitro selection can also be cleaved by ZFNs in cells, we examined 34 or 90 sites for evidence of ZFN-induced mutagenesis in cultured human K562 cells expressing the CCR5-224 or VF2468 ZFNs, respectively. Ten of the CCR5-224 sites and 32 of the VF2468 sites we tested show DNA sequence changes consistent with ZFN-mediated cleavage in human cells, although we anticipate that cleavage is likely to be dependent on cell type and ZFN concentration. One CCR5-224 off-target site lies in a promoter of the malignancy-associated BTBD10 gene.

Our results, which could not have been obtained by determining binding specificities of monomeric zinc finger domains alone, indicate that excess DNA-binding energy results in increased off-target ZFN cleavage activity and suggest that ZFN specificity can be enhanced by designing ZFNs with decreased binding affinity, by lowering ZFN expression levels, and by choosing target sites that differ by at least three base pairs from their closest sequence relatives in the genome.

Results

In Vitro Selection for ZFN-mediated DNA Cleavage

Figure 5:
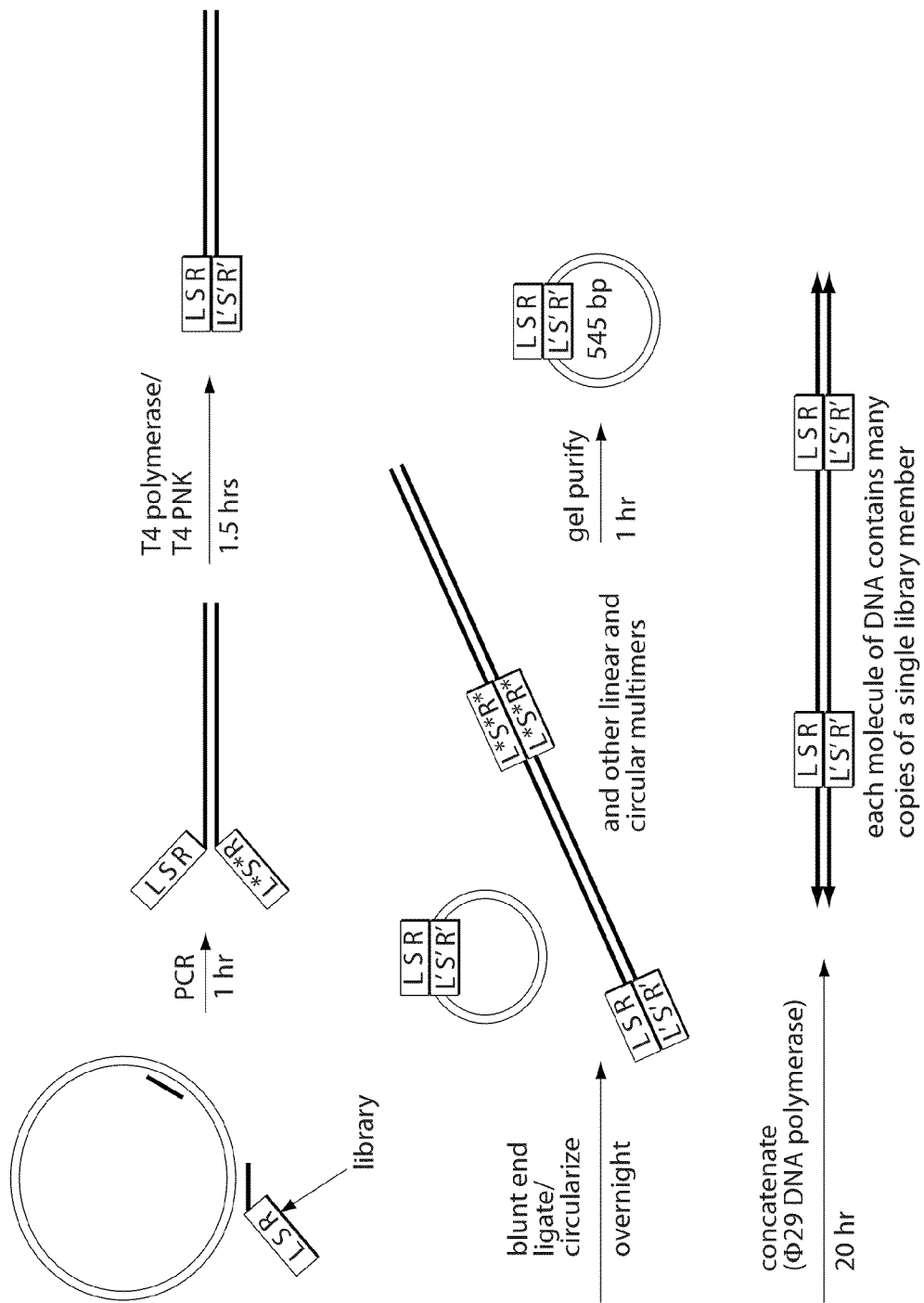
FIG. 5. In vitro synthesis of target site library. Library members consist of a partially randomized left-half site (L), a fully randomized 4-7 nucleotide spacer sequence (S), and a partially randomized right-half site (R). Library members present on DNA primers were incorporated into a linear ~545 base pair double-stranded DNA by PCR. During PCR, a primer with a library member (L S R) can anneal to a DNA strand with a different library member (L*S*R*), resulting in a double-strand DNA with two different library members at one end. The 3'-5' exonuclease and 5'-3' polymerase activities of T4 DNA polymerase removed mismatched library members and replaced them with complementary, matched library members (L'S'R'). After 5' phosphorylation with T4 polynucleotide kinase, the library DNA was subjected to blunt-end ligation, resulting in a mixture of linear and circular monomeric and multimeric species. Circular monomers were purified by gel electrophoresis and concatenated through rolling-circle amplification with Φ29 DNA polymerase.
Figure 6A:
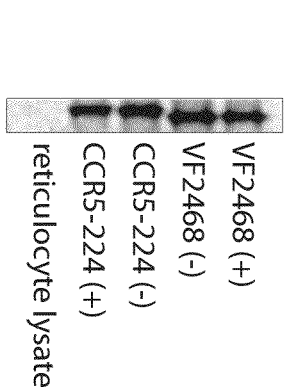
FIGS. 6A-D. Expression and quantification of ZFNs. Western blots for CCR5-224 and VF2468 are shown (a) for the ZFN samples used in the in vitro selection, and (b) for quantification. (c) Known quantities of N-terminal FLAG-tagged bacterial alkaline phosphatase (FLAG-BAP) were used to generate a standard curve for ZFN quantification. Diamonds represent the intensities of FLAG-BAP standards from the Western blot shown in (b), plus signs represent the intensities of bands of ZFNs, and the line shows the best-fit curve of FLAG-BAP standards that was used to quantify ZFNs. (d) Gels are shown of activity assays of CCR5-224 and VF2468 on an 8 nM linear substrate containing one target cleavage site. The ZFNs were each incubated with their respective substrate for 4 hours at 37° C. DNA in the "+lysate" lane was incubated with an amount of in vitro transcription/translation mixture equivalent to that used in the 2.5 nM ZFN reaction. ZFN-mediated cleavage results in two linear fragments approximately 700 bp and 300 bp in length. 2 nM CCR5-224 and 1 nM VF2468 were the amounts required for 50% cleavage of the linear substrate.
Figure 6B:
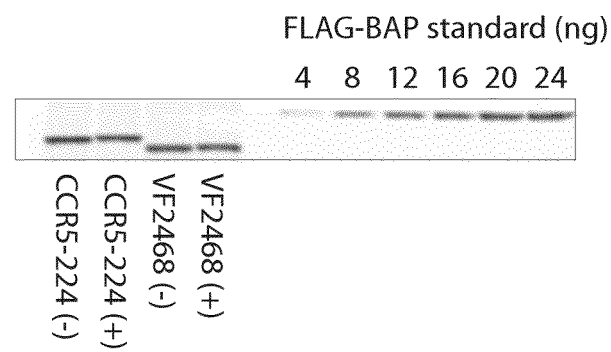
Figure 6C:
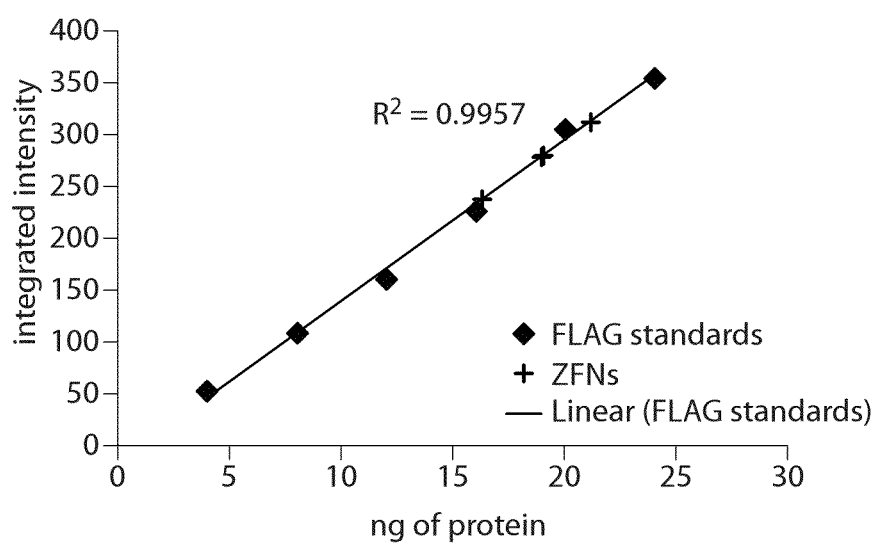
Figure 6D:
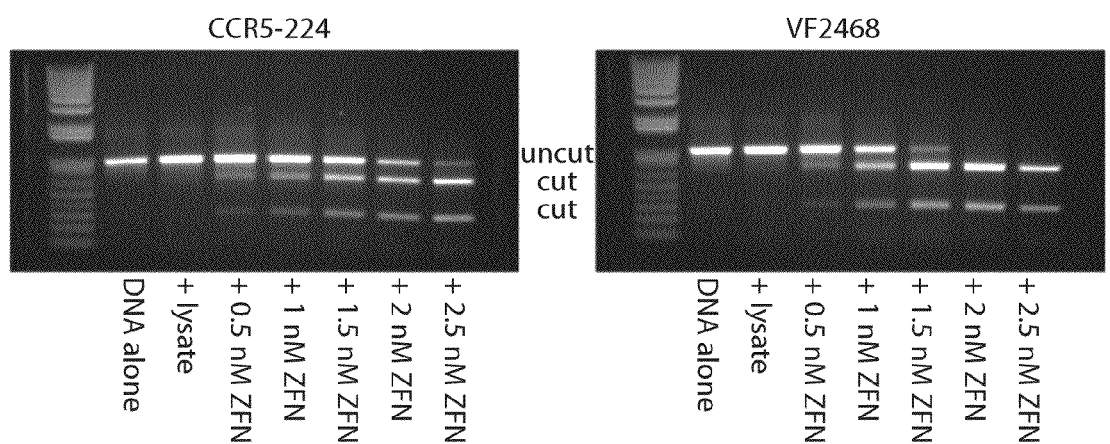

Libraries of potential cleavage sites were prepared as double-stranded DNA using synthetic primers and PCR (FIG. 5). Each partially randomized position in the primer was synthesized by incorporating a mixture containing 79% wild-type phosphoramidite and 21% of an equimolar mixture of all three other phosphoramidites. Library sequences therefore differed from canonical ZFN cleavage sites by 21% on average, distributed binomially. We used a blunt ligation strategy to create a $10^{12}$-member minicircle library. Using rolling-circle amplification, >$10^{11}$ members of this library were both amplified and concatenated into high molecular weight (>12 kb) DNA molecules. In theory, this library covers with at least 10-fold excess all DNA sequences that are seven or fewer mutations from the wild-type target sequences.

Figure 7A:
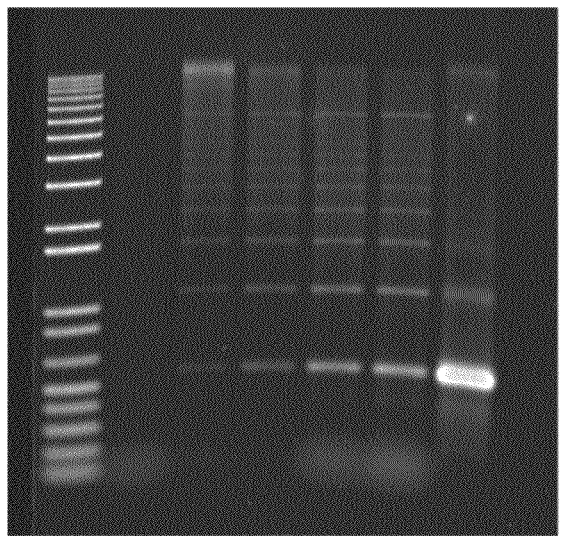
FIGS. 7A-B. Library cleavage with ZFNs. Cleavage of 1 μg of concatemeric libraries of CCR5-224 (a) or VF2468(b) target sites are shown with varying amounts CCR5-224 or VF2468, respectively. The lane labeled "+lysate" refers to pre-selection concatemeric library incubated with the volume of in vitro transcription/translation mixture contained in the samples containing 4 nM CCR5-224 or 4 nM of VF2468. Uncut DNA, which would be observed in the "+lysate" lane, is of length>12 kb and is lost upon purification due to its size and therefore is not present on the gel. The lane labeled "+PvuI" is a digest of the pre-selection library at PvuI sites introduced adjacent to library members. The laddering on the gels results from cleavage of pre-selection DNA concatemers at more than one site. There is a dose dependent increase in the amount of the bottom band, which corresponds to cleavage at two adjacent library sites in the same pre-selection DNA molecule. This bottom band of DNA was enriched by PCR and gel purification before sequencing.
Figure 7B:
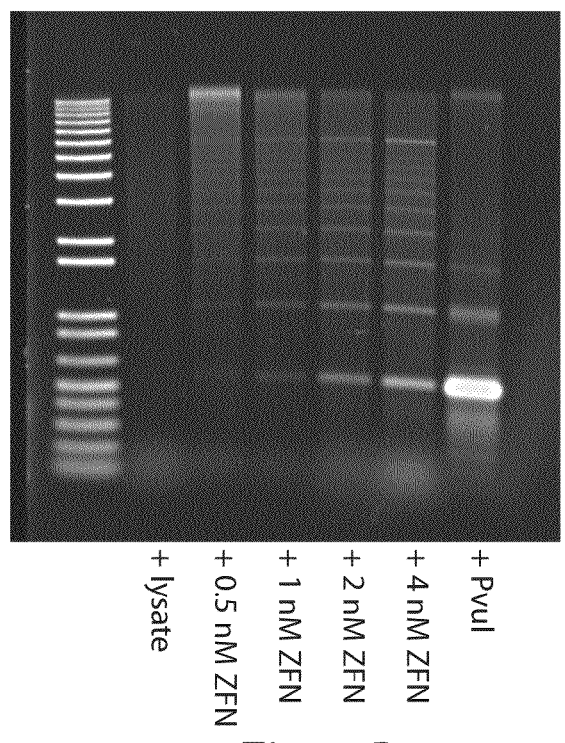
Figure 8A:
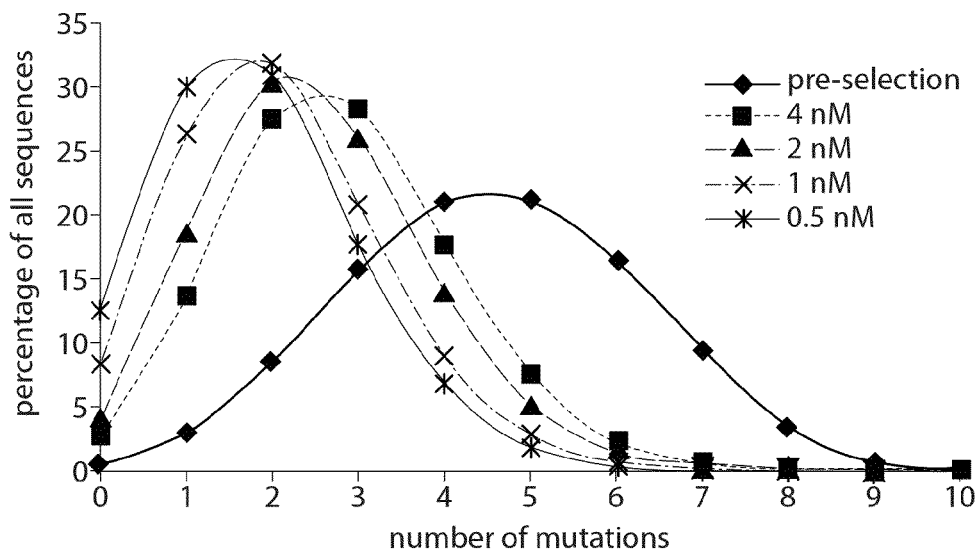
FIGS. 8A-B. ZFN off-target cleavage is dependent on enzyme concentration. For both (a) CCR5-224 and (b) VF2468 the distribution of cleavable sites revealed by in vitro selection shifts to include sites that are less similar to the target site as the concentration of ZFN increases. Both CCR5-224 and VF2468 selections enrich for sites that have fewer mutations than the pre-selection library. For comparisons between preselection and post-selection library means for all combinations of selection stringencies, P-values are 0 with the exception of the comparison between 0.5 nM and 1 nM VF2468 selections, which has a P-value of $1.7 \times 10^{-14}$.
Figure 8B:
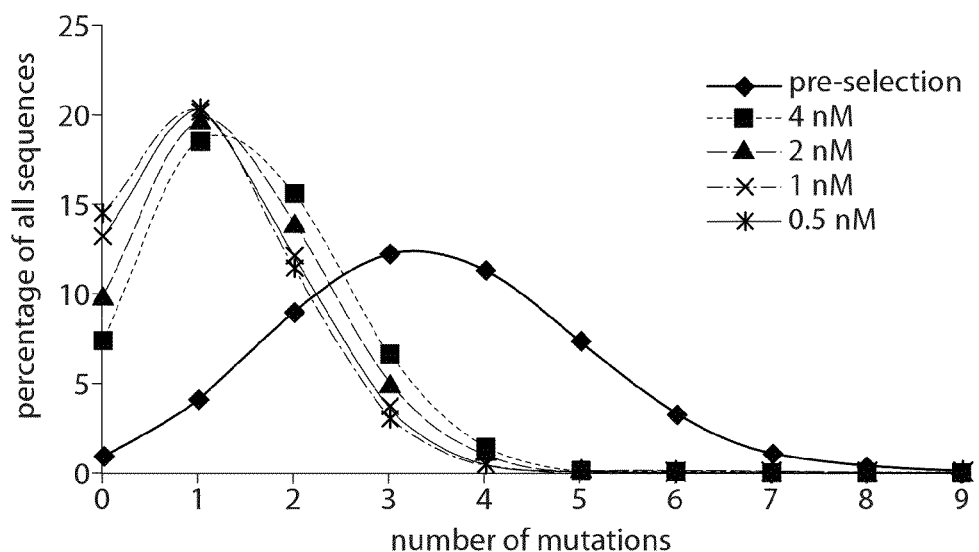

We incubated the CCR5-224 or VF2468 DNA cleavage site library at a total cleavage site concentration of 14 nM with two-fold dilutions, ranging from 0.5 nM to 4 nM, of crude in vitro-translated CCR5-224 or VF2468, respectively (FIG. 6). Following digestion, we subjected the resulting DNA molecules (FIG. 7) to in vitro selection for DNA cleavage and subsequent paired-end high-throughput DNA sequencing. Briefly, three selection steps (FIG. 1) enabled the separation of sequences that were cleaved from those that were not. First, only sites that had been cleaved contained 5' phosphates, which are necessary for the ligation of adapters required for sequencing. Second, after PCR, a gel purification step enriched the smaller, cleaved library members. Finally, a computational filter applied after sequencing only counted sequences that have filled-in, complementary 5' overhangs on both ends, the hallmark for cleavage of a target site concatemer (Table 2 and Protocols 1-9). We prepared pre-selection library sequences for sequencing by cleaving the library at a PvuI restriction endonuclease recognition site adjacent to the library sequence and subjecting the digestion products to the same protocol as the ZFN-digested library sequences. High-throughput sequencing confirmed that the rolling-circle-amplified, pre-selection library contained the expected distribution of mutations (FIG. 8).

Design of an In Vitro Selection for ZFN-mediated DNA Cleavage.

To characterize comprehensively the DNA cleavage specificity of active ZFNs, we first generated a large library of potential DNA substrates that can be selected for DNA cleavage in one step without requiring iterative enrichment steps that could amplify noise and introduce bias. We designed the substrate library such that each molecule in the library is a concatemer of one of >$10^{11}$ potential substrate sequences (FIG. 5). Incubation with ZFN results in some molecules that are uncut, some that have been cut once, and some that have been cut at least twice. Those molecules that have been cleaved at least twice have ends consisting of each half of the cleaved DNA sequence (FIG. 1). Cut library members are enriched relative to uncut library members in three ways (FIG. 1). First, sequences that have been cleaved twice have two complementary 5' overhangs, which can be identified computationally following DNA sequencing as hallmarks of bona fide cleavage products. Second, since ZFN-mediated cleavage reveals 5' phosphates that are not present in the pre-selection library, only DNA that has undergone cleavage is amenable to sequencing adapter ligation. Third, after PCR using primers complementary to the sequencing adapters, a gel purification step ensures that all sequenced material is of a length consistent with library members that have been cleaved at two adjacent sites. This gel-purified material is subjected to high-throughput DNA sequencing using the Illumina method (Bentley, D. R. et al. Accurate whole human genome sequencing using reversible terminator chemistry. Nature 456, 53-9 (2008)). Ideally, the library used in a ZFN cleavage selection would consist of every possible DNA sequence of the length recognized by the ZFN. Only one out of every 105 members of such a library, however, would contain a sequence that was within seven mutations of a 24-base pair recognition sequence. Since off-target recognition sequences most likely resemble target recognition sites, we used instead a biased library that ensures >10-fold coverage of all half-site sequences that differ from the wild-type recognition sequences by up to seven mutations. Library members consist of a fully randomized base pair adjacent to the 5' end of the recognition site, two partially randomized half sites flanking a 4-, 5-, 6-, or 7-bp fully randomized spacer, and another fully randomized base pair adjacent to the 3' end of the recognition site. A fully randomized five-base pair tag follows each library member. This tag, along with the randomized flanking base pairs and the randomized spacer sequence, was used as a unique identifier "key" for each library member. If this unique key was associated with more than one sequence read containing identical library members, these duplicate sequencing reads likely arose during PCR amplification and were therefore treated as one data point.
Analysis of CCR5-224 and VF2468 ZFNs Using the DNA Cleavage Selection.

Each member of a sequence pair consisted of a fragment of the spacer, an entire half-site, an adjacent nucleotide, and constant sequence. One end of the spacer was generally found in one sequence and the other end in its corresponding paired sequence, with the overhang sequence present in both paired sequence reads because overhangs were blunted by extension prior to ligation of adapters. The spacer sequences were reconstructed by first identifying the shared overhang sequence and then any nucleotides present between the overhang sequence and the half-site sequence. Only sequences containing no ambiguous nucleotides and overhangs of at least 4 nucleotides were analyzed. Overall, this computational screen for unique sequences that originated from two cleavage events on identical library members yielded 2.0 million total reads of cleaved library members (Table 2). There are far fewer analyzed sequences for the 0.5 nM, 1 nM, and 2 nM CCR5-224 and VF2468 selections compared to the 4 nM selections due to the presence of a large number of sequence repeats, identified through the use of the unique identifier key described above. The high abundance of repeated sequences in the 0.5 nM, 1 nM, and 2 nM selections indicate that the number of sequencing reads obtained in those selections, before repeat sequences were removed, was larger than the number of individual DNA sequences that survived all experimental selection steps. We estimated the error rate of sequencing to be 0.086% per nucleotide by analysis of a constant nucleotide in all paired reads. Using this error rate, we estimate that 98% of the post-selection ZFN target site sequences contain no errors.

Off-target Cleavage is Dependent on ZFN Concentration

Figure 9A:
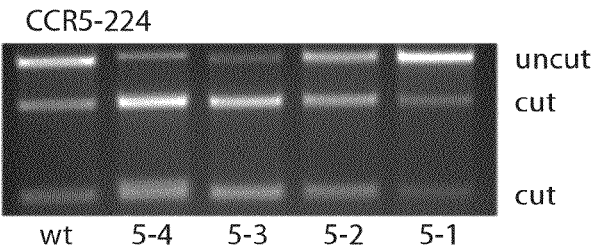
FIGS. 9A-B. Cleavage efficiency of individual sequences is related to selection stringency. In vitro DNA digests were performed on sequences identified in selections of varying stringencies (marked with 'X's). 2 nM CCR5-224 (SEQ ID NOs:7-14) (a) or 1 nM VF2468 (SEQ ID NOs:15-24) (b) was incubated with 8 nM of linear substrate containing the sequence shown. The 1 kb linear substrate contained a single cleavage site with the spacer sequence found in the genomic target of CCR5-224 ("CTGAT") or VF2468 ("TCGAA") and the indicated (+) and (−) half-sites. Mutant base pairs are represented with lowercase letters. CCR5-224 sites and VF2468 sites that were identified in the highest stringency selections (0.5 nM ZFN) are cleaved most efficiently, while sites that were identified only in the lowest stringency selections (4 nM ZFN) are cleaved least efficiently. Sequences in FIG. 9A correspond, from top to bottom, to SEQ ID NOs: 7-14. Sequences in FIG. 9B correspond, from top to bottom, to SEQ ID NOs: 15-24.
Figure 9B:
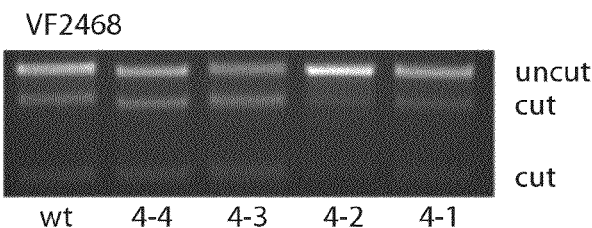

As expected, only a subset of library members was cleaved by each enzyme. The pre-selection libraries for CCR5-224 and VF2468 contained means of 4.56 and 3.45 mutations per complete target site (two half-sites), respectively, while post-selection libraries exposed to the highest concentrations of ZFN used (4 nM CCR5-224 and 4 nM VF2468) had means of 2.79 and 1.53 mutations per target site, respectively (FIG. 8). As ZFN concentration decreased, both ZFNs exhibited less tolerance for off-target sequences. At the lowest concentrations (0.5 nM CCR5-224 and 0.5 nM VF2468), cleaved sites contained an average of 1.84 and 1.10 mutations, respectively. We placed a small subset of the identified sites in a new DNA context and incubated in vitro with 2 nM CCR5-224 or 1 nM VF2468 for 4 hours at 37° C. (FIG. 9). We observed cleavage for all tested sites and those sites emerging from the more stringent (low ZFN concentration) selections were cleaved more efficiently than those from the less stringent selections. Notably, all of the tested sequences contain several mutations, yet some were cleaved in vitro more efficiently than the designed target.

Figure 2A:
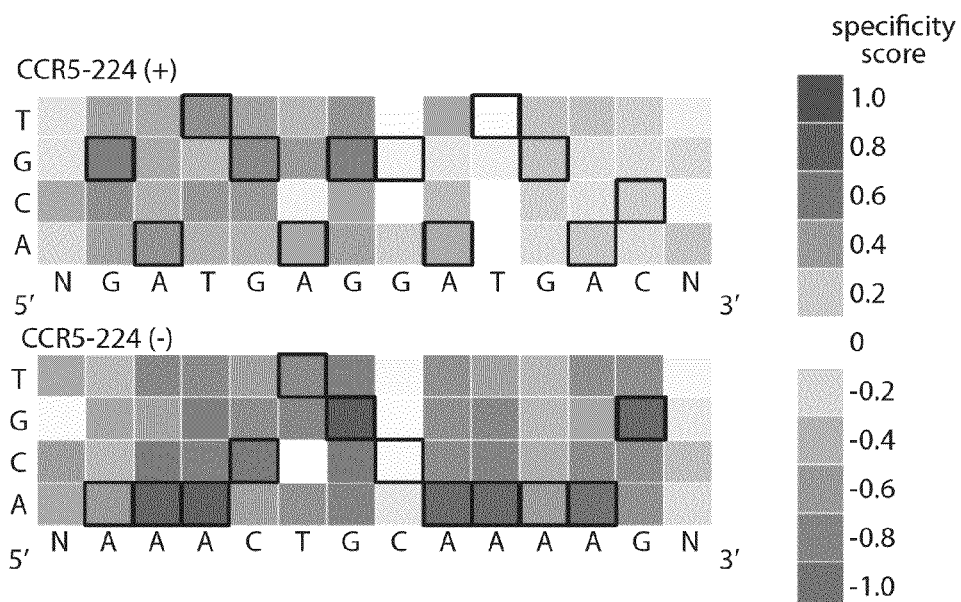
FIGS. 2A-B. DNA cleavage sequence specificity profiles for CCR5-224 and VF2468 ZFNs. The heat maps show specificity scores compiled from all sequences identified in selections for cleavage of 14 nM of DNA library with (a) 2 nM CCR5-224 or (b) 1 nM VF2468. The target DNA sequence is shown below each half-site. Black boxes indicate target base pairs. Specificity scores were calculated by dividing the change in frequency of each base pair at each position in the post-selection DNA pool compared to the pre-selection pool by the maximal possible change in frequency from pre-selection library to post-selection library of each base pair at each position. Blue boxes indicate enrichment for a base pair at a given position, white boxes indicate no enrichment, and red boxes indicate enrichment against a base pair at a given position. The darkest blue shown in the legend corresponds to absolute preference for a given base pair (specificity score=1.0), while the darkest red corresponds to an absolute preference against a given base pair (specificity score=−1.0). Sequences correspond, from top to bottom, to SEQ ID NOs: 1 and 2 (FIG. 2A) and SEQ ID NOs: 3 and 4 (FIG. 2B).
Figure 2B:
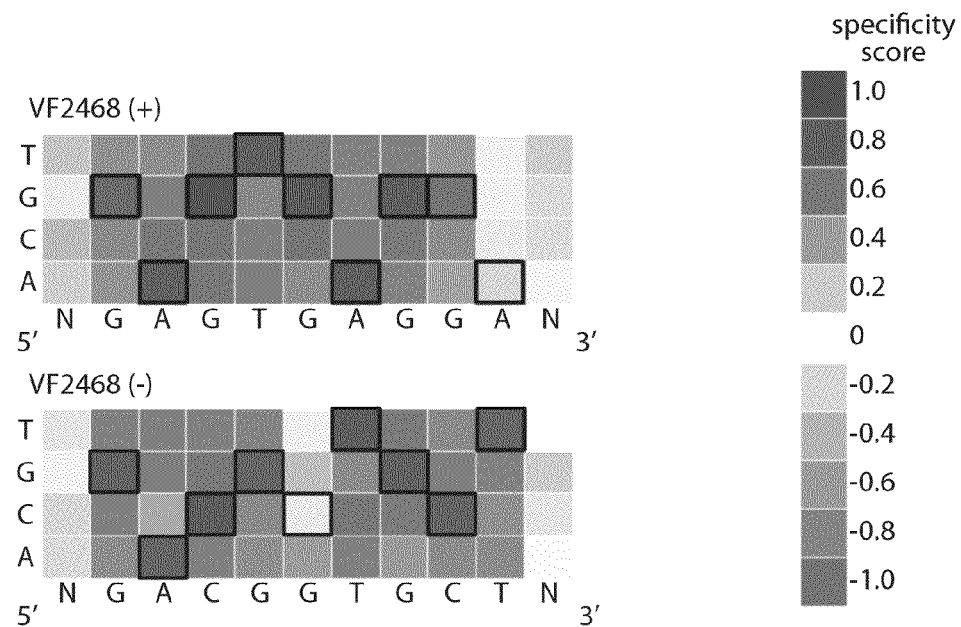
Figure 3A:
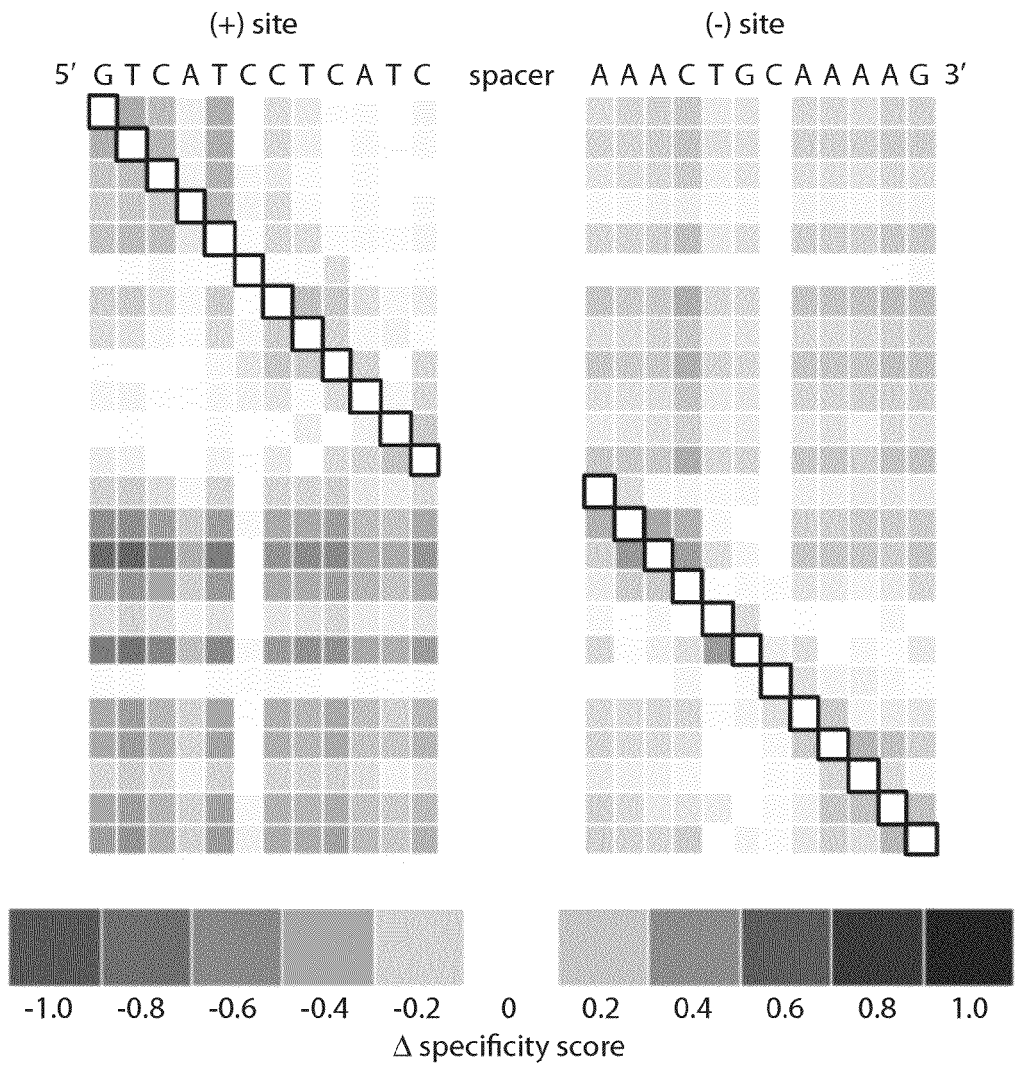
FIGS. 3A-B. Evidence for a compensation model of ZFN target site recognition. The heat maps show the changes in specificity score upon mutation at the black-boxed positions in selections with (a) 2 nM CCR5-224 or (b) 1 nM VF2468. Each row corresponds to a different mutant position (explained graphically in FIG. 12). Sites are listed in their genomic orientation; the (+) half-site of CCR5-224 and the (+) half-site of VF2468 are therefore listed as reverse complements of the sequences found in FIG. 2. Shades of blue indicate increased specificity score (more stringency) when the black boxed position is mutated and shades of red indicate decreased specificity score (less stringency). Sequences in FIG. 3A correspond, from top to bottom, to SEQ ID NOs: 5-6.
Figure 3B:
Figure 3B:
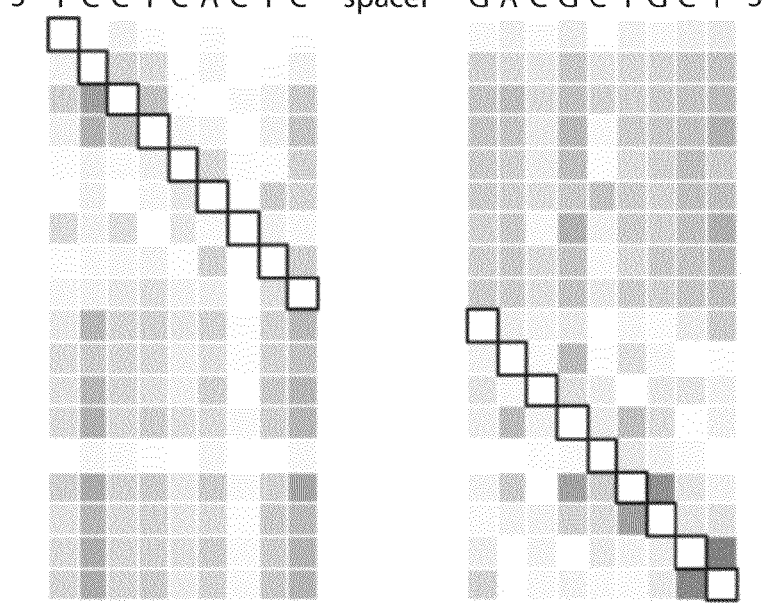
Figure 3B:
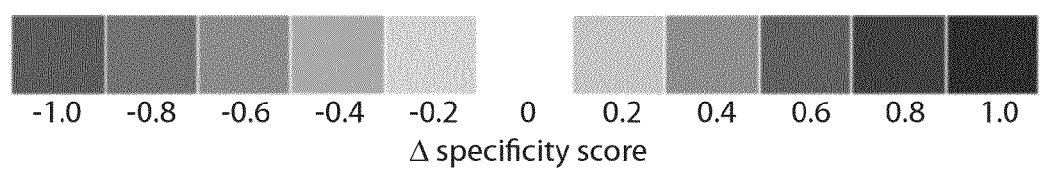
Figure 10A:
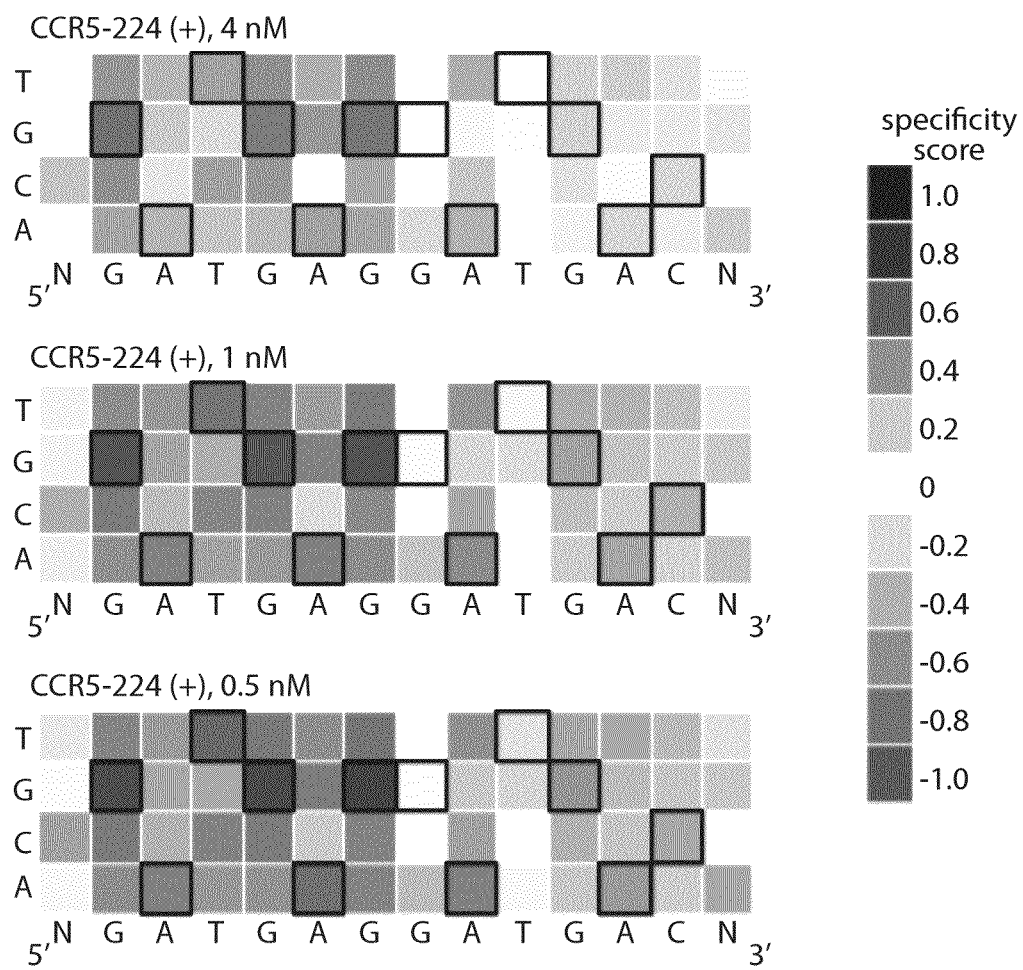
FIGS. 10A-D. Concentration-dependent sequence profiles for CCR5-224 and VF2468 ZFNs. The heat maps show specificity scores for the cleavage of 14 nM of total DNA library with varying amounts of (a-b) CCR5-224 or (c-d) VF2468. The target DNA sequence is shown below each half-site. Black boxes indicate target base pairs. Specificity scores were calculated by dividing the change in frequency of each base pair at each position in the post-selection DNA pool compared to the pre-selection pool by the maximal possible change in frequency of each base pair at each position. Blue boxes indicate specificity for a base pair at a given position, white boxes indicate no specificity, and red boxes indicate specificity against a base pair at a given position. The darkest blue shown in the legend corresponds to absolute preference for a given base pair (specificity score=1.0), while the darkest red corresponds to an absolute preference against a given base pair (specificity score=−1.0). Sequences in FIGS. 10A-D correspond, from top to bottom, to SEQ ID NOs: 25-28.
Figure 10B:
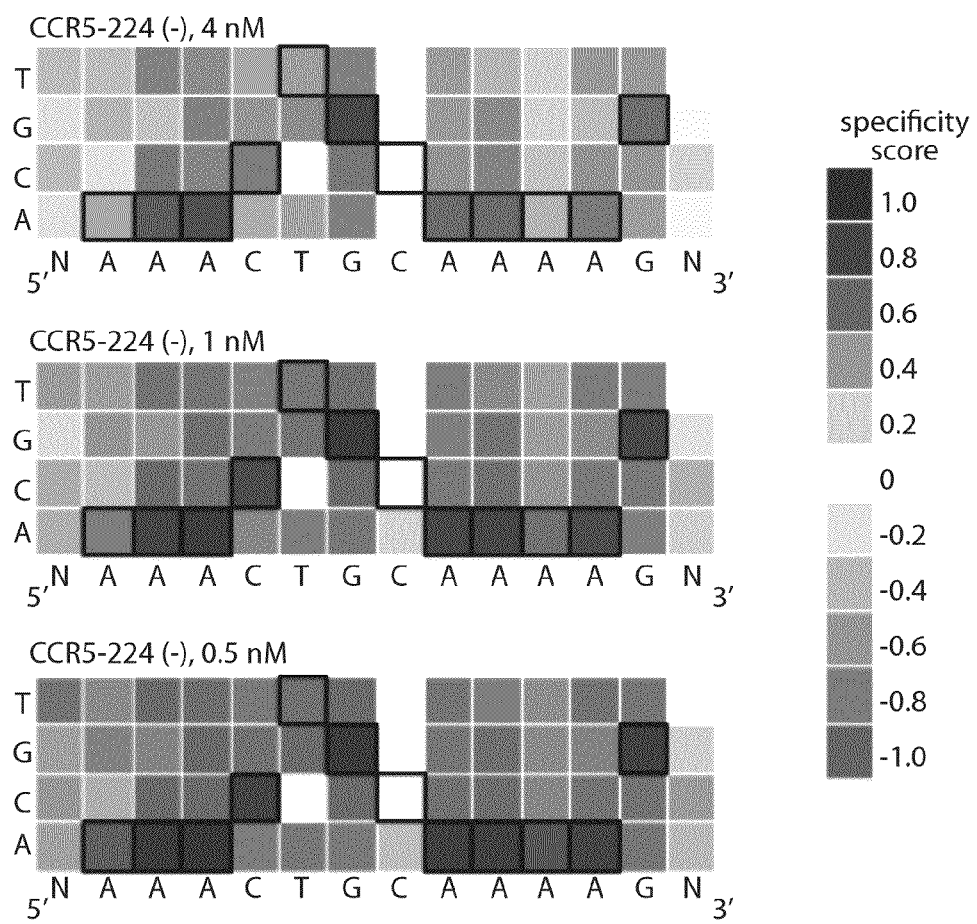
Figure 10C:
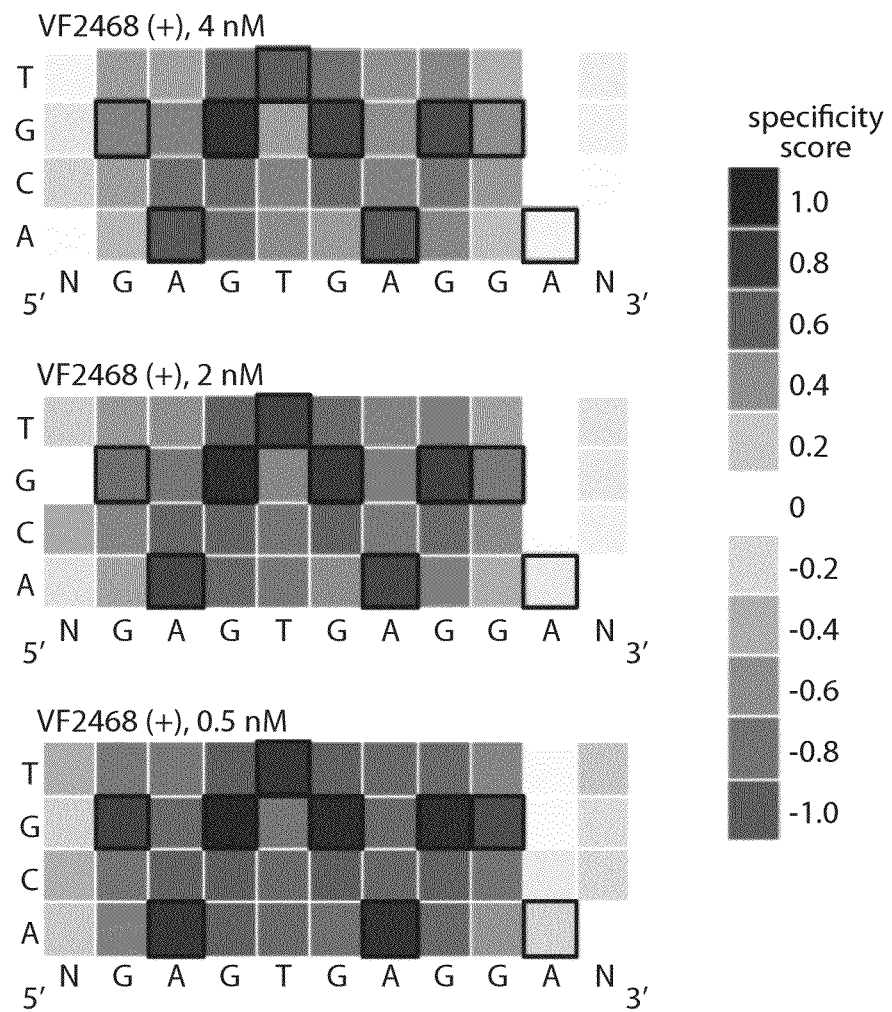
Figure 10D:
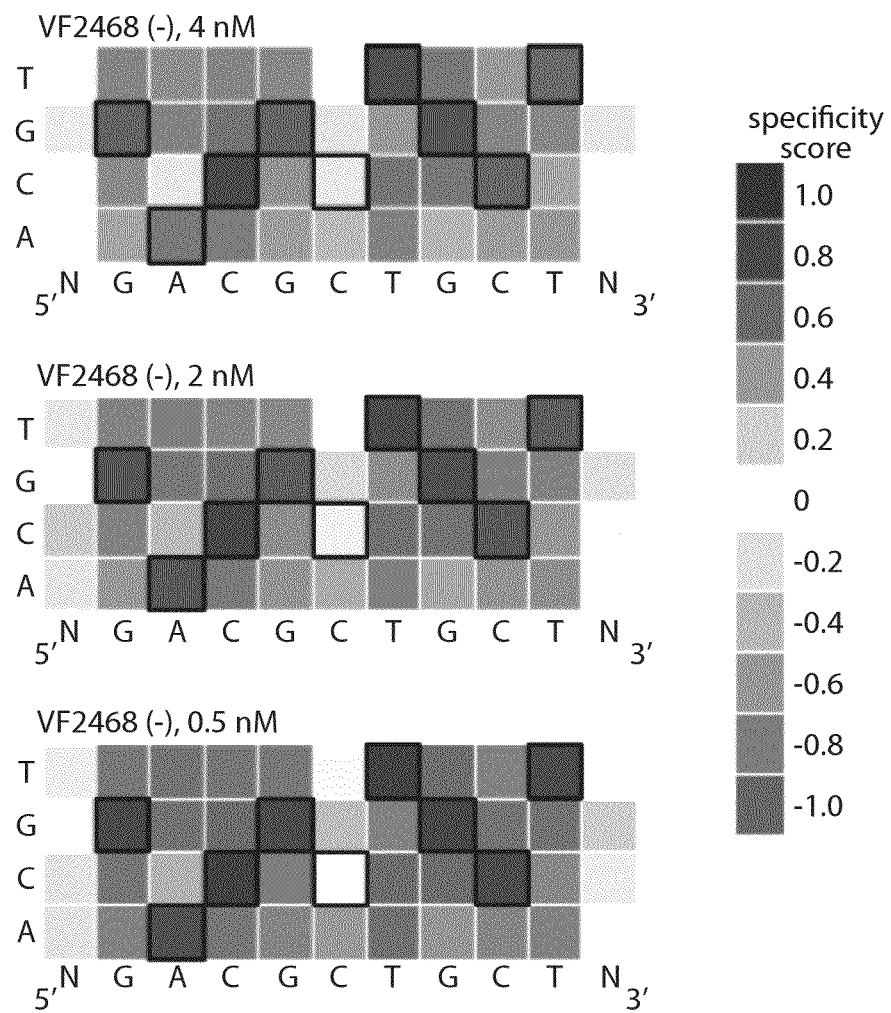

The DNA-cleavage specificity profile of the dimeric CCR5-224 ZFN (FIG. 2a and FIG. 10a,b) was notably different than the DNA-binding specificity profiles of the CCR5-224 monomers previously determined by SELEX[6]. For example, some positions, such as (+)A5 and (+)T9, exhibited tolerance for off-target base pairs in our cleavage selection that were not predicted by the SELEX study. VF2468, which had not been previously characterized with respect to either DNA-binding or DNA-cleavage specificity, revealed two positions, (−)C5 and (+)A9, that exhibited limited sequence preference, suggesting that they were poorly recognized by the ZFNs (FIG. 2b and FIG. 10c,d).

Compensation Between Half-sites Affects DNA Recognition

Figure 11:
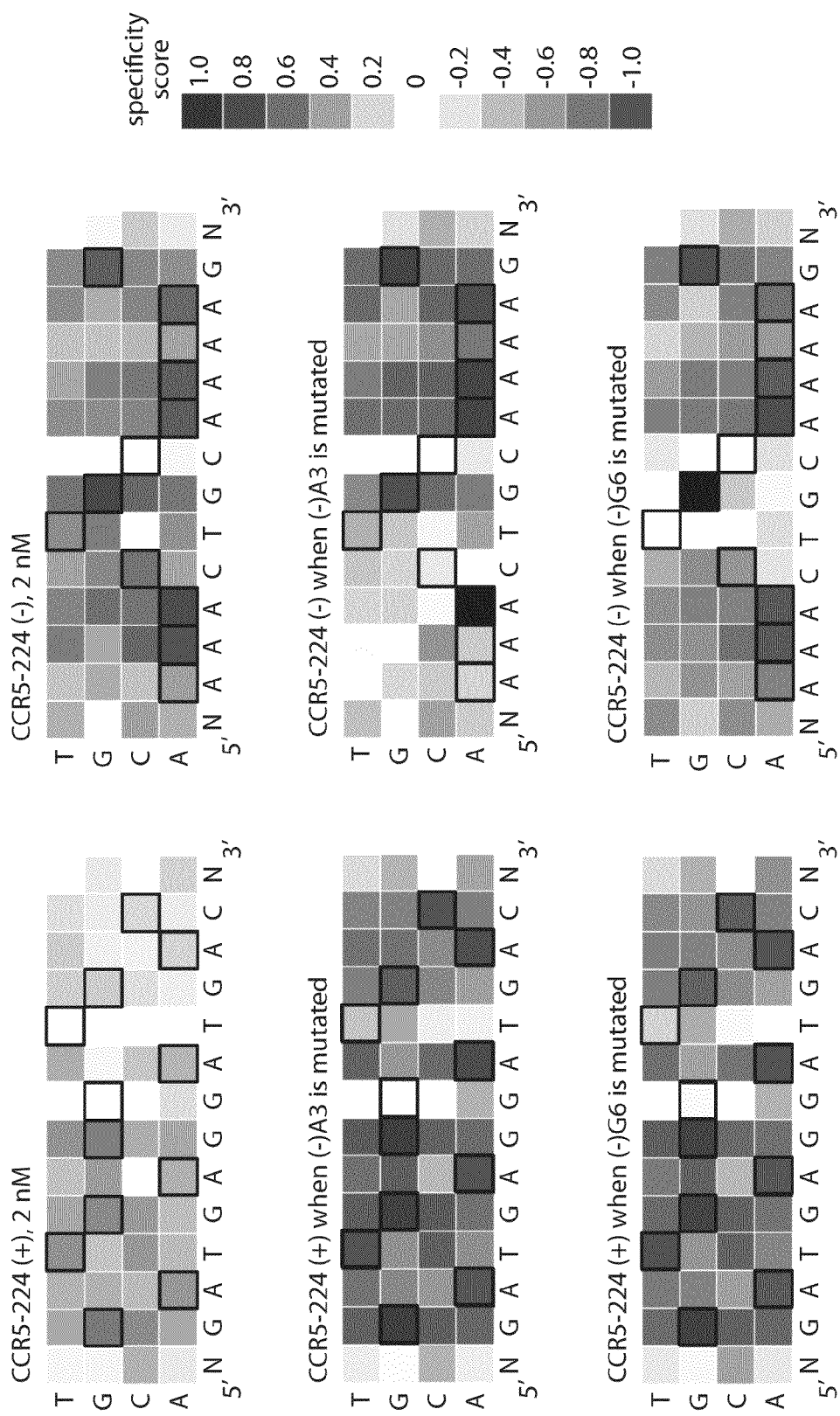
FIG. 11. Stringency at the (+) half-site increases when CCR5-224 cleaves sites with mutations at highly specified base pairs in the (−) half-site. The heat maps show specificity scores for sequences identified in the in vitro selection with 2 nM CCR5-224. For (−)A3 and (−)G6, indicated by filled black boxes, both pre-selection library sequences and post-selection sequences were filtered to exclude any sequences that contained an A at position 3 in the (−) half-site or G at position 6 in the (−) half-site, respectively, before specificity scores were calculated. For sites with either (−) half-site mutation, there is an increase in specificity at the (+) half-site. Black boxes indicate target base pairs. Specificity scores were calculated by dividing the change in frequency of each base pair at each position in the post-selection DNA pool compared to the pre-selection pool by the maximal possible change in frequency of each base pair at each position. Blue boxes indicate specificity for a base pair at a given position, white boxes indicate no specificity, and red boxes indicate specificity against a base pair at a given position. The darkest blue shown in the legend corresponds to absolute preference for a given base pair (specificity score=1.0), while the darkest red corresponds to an absolute preference against a given base pair (specificity score=−1.0). Sequences on the left correspond to SEQ ID NO: 29. Sequences on the right correspond to SEQ ID NO: 30.
Figure 12A:
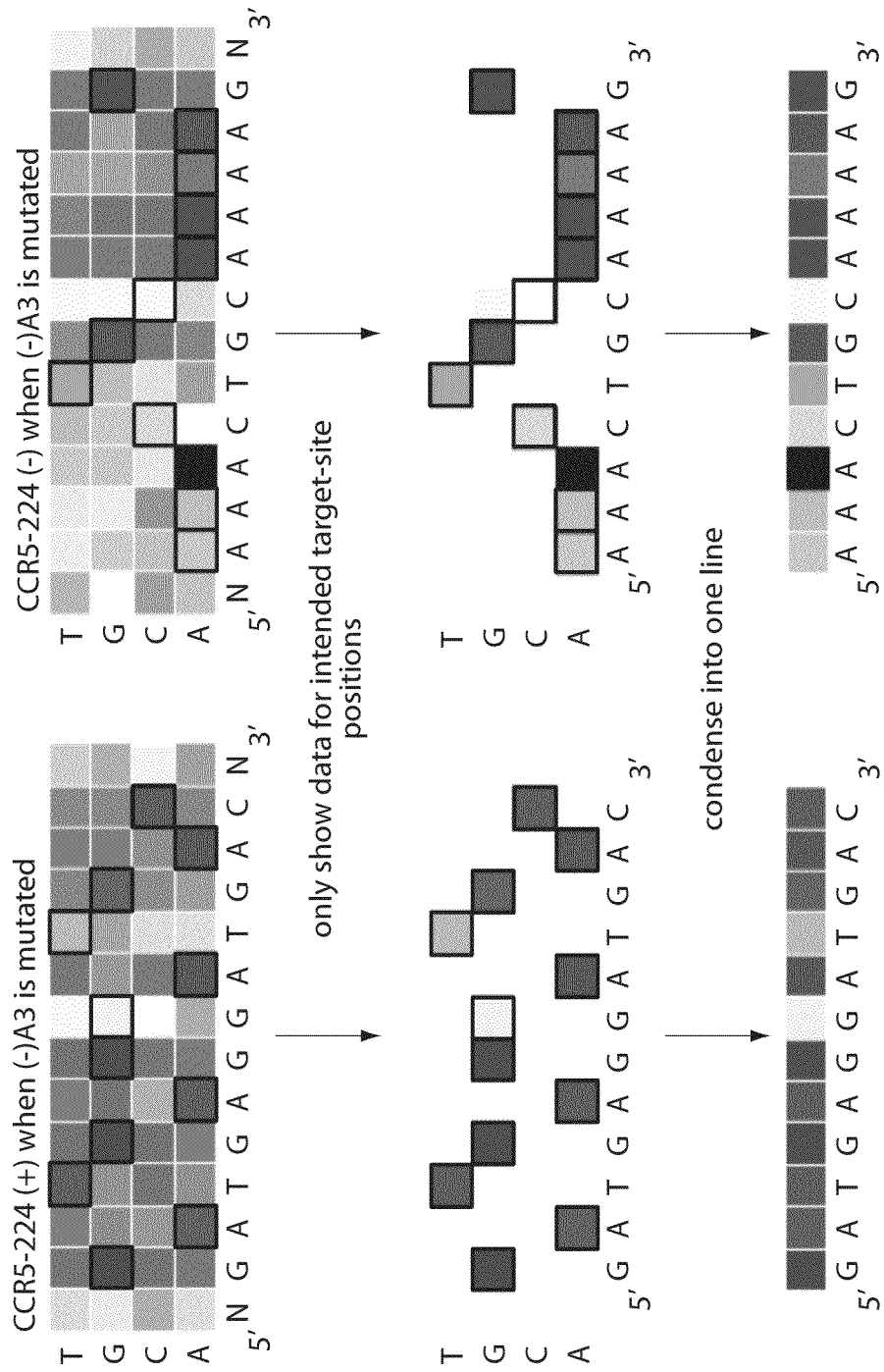
FIGS. 12A-B. Data processing steps used to create mutation compensation difference maps. The steps to create each line of the difference map in FIG. 3 are shown for the example of a mutation at position (−)A3. (a) Heat maps of the type described in FIG. 11 are condensed into one line to show only the specificity scores for intended target site nucleotides (in black outlined boxes in FIG. 11). (b) The condensed heat maps are then compared to a condensed heat map corresponding to the unfiltered baseline profile from FIG. 2, to create a condensed difference heat map that shows the relative effect of mutation at the position specified by the white box with black outline on the specificity score profile. Blue boxes indicate an increase in sequence stringency at positions in cleaved sites that contain mutations at the position indicated by the white box, while red boxes indicate a decrease in sequence stringency and white boxes, no change in sequence stringency. The (+) half-site difference map is reversed to match the orientation of the (+) half-site as it is found in the genome rather than as it is recognized by the zinc finger domain of the ZFN. Sequences in FIG. 12A correspond, from top left to bottom right, to SEQ ID NOs:31-36. Sequences in FIG. 12B correspond to SEQ ID NOs: 37 and 38 (left) and SEQ ID NO: 39 (right).
Figure 12B:
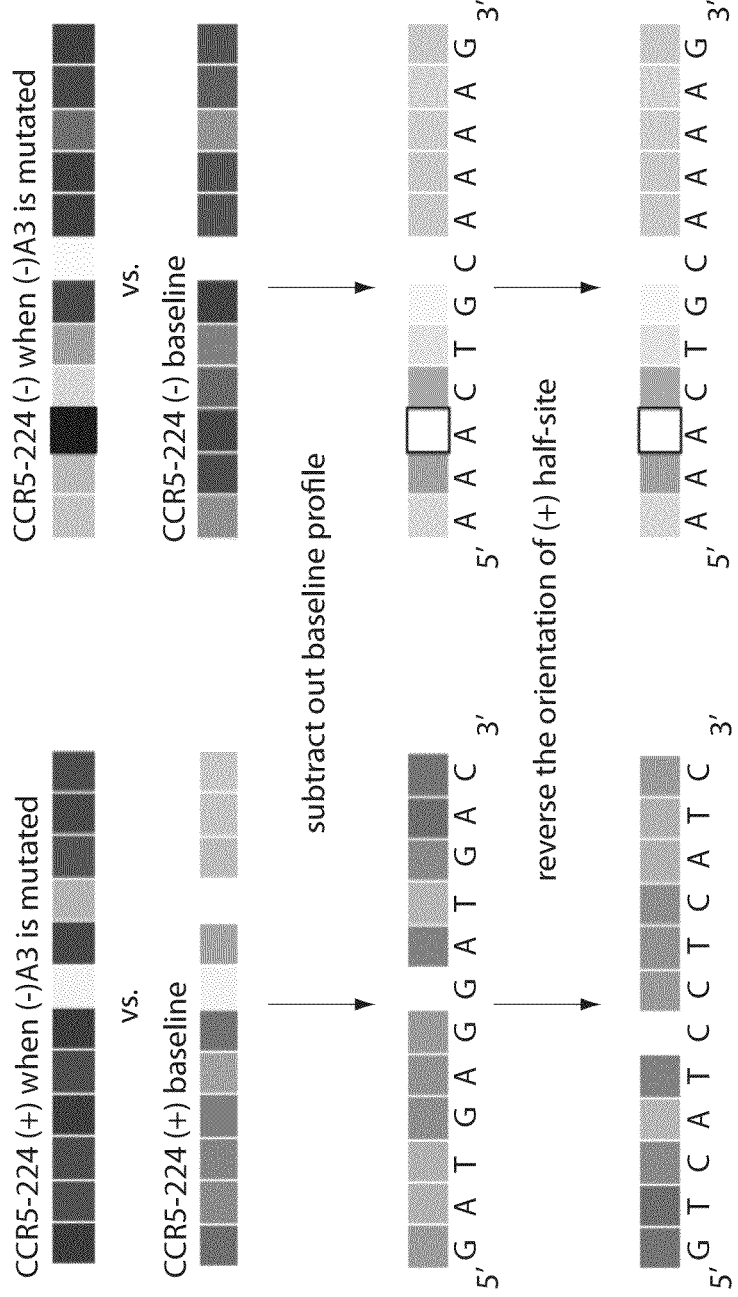
Figure 13:
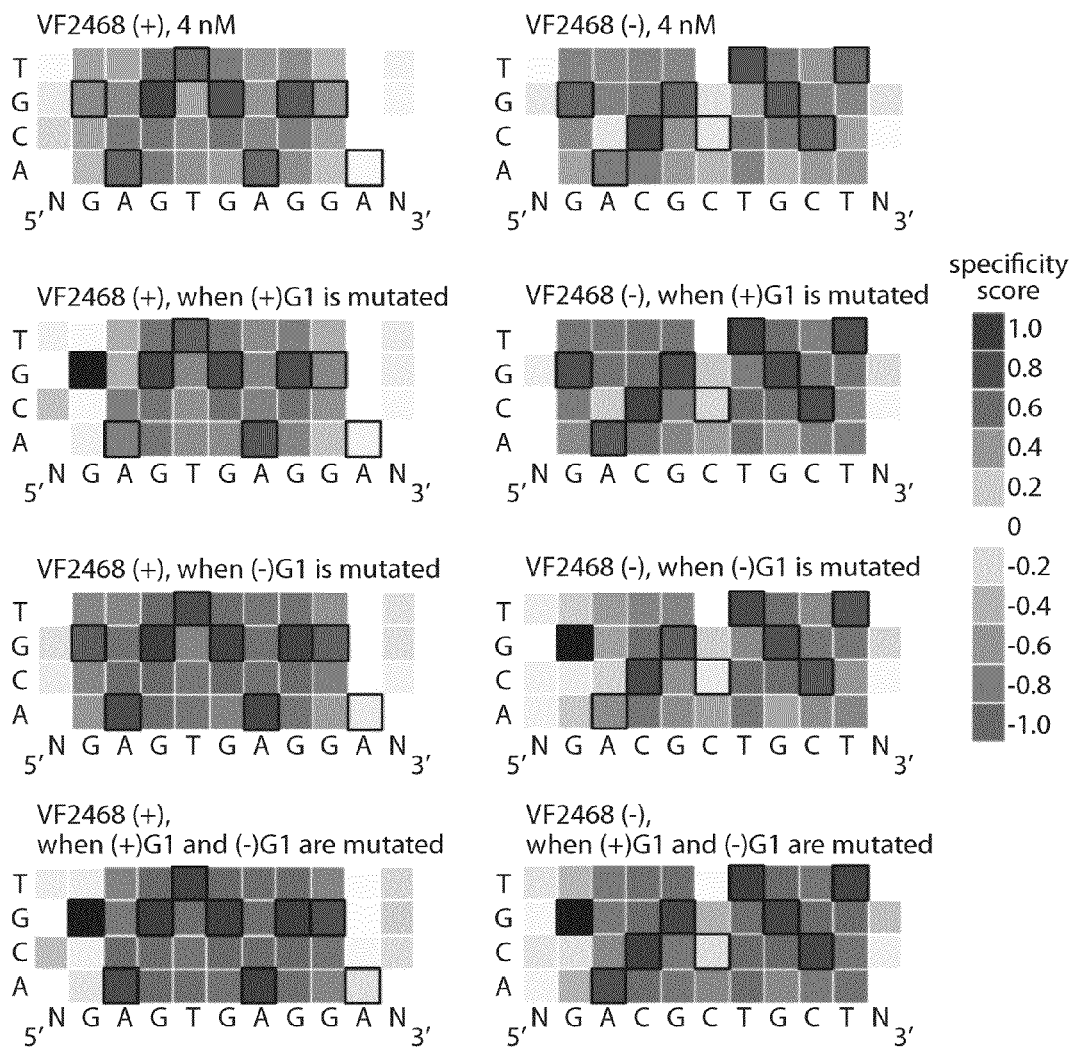
FIG. 13. Stringency at both half-sites increases when VF2468 cleaves sites with mutations at the first base pair of both half-sites. The heat maps show specificity scores for sequences identified in the in vitro selection with 4 nM VF2468. For (+)G1, (−)G1, and (+)G1/(−)G1, indicated by filled black boxes, both pre-selection library sequences and post-selection sequences were filtered to exclude any sequences that contained an G at position 1 in the (+) half-site and/or G at position 1 in the (−) half-site, before specificity scores were calculated. For sites with either mutation, there is decrease in mutational tolerance at the opposite half-site and a very slight decrease in mutational tolerance at the same half-site. Sites with both mutations show a strong increase in stringency at both half-sites. Black boxes indicate on-target base pairs. Specificity scores were calculated by dividing the change in frequency of each base pair at each position in the post-selection DNA pool compared to the pre-selection pool by the maximal possible change in frequency of each base pair at each position. Blue boxes indicate specificity for a base pair at a given position, white boxes indicate no specificity, and red boxes indicate specificity against a base pair at a given position. The darkest blue shown in the legend corresponds to absolute preference for a given base pair (specificity score=1.0), while the darkest red corresponds to an absolute preference against a given base pair (specificity score=−1.0). Sequences correspond to SEQ ID NO:40 for VF2468(+) and SEQ ID NO: 41 for VF2468(−).

Our results reveal that ZFN substrates with mutations in one half-site are more likely to have additional mutations in nearby positions in the same half-site compared to the pre-selection library and less likely to have additional mutations in the other half-site. While this effect was found to be largest when the most strongly recognized base pairs were mutated (FIG. 11), we observed this compensatory phenomenon for all specified half-site positions for both the CCR5 and VEGF-targeting ZFNs (FIG. 3 and FIG. 12). For a minority of nucleotides in cleaved sites, such as VF2468 target site positions (+)G1, (−)G1, (−)A2, and (−)C3, mutation led to decreased tolerance of mutations in base pairs in the other half-site and also a slight decrease, rather than an increase, in mutational tolerance in the same half-site. When two of these mutations, (+)G1 and (−)G1, were enforced at the same time, mutational tolerance at all other positions decreased (FIG. 13). Collectively, these results show that tolerance of mutations at one half-site is influenced by DNA recognition at the other half-site.

Figure 14A:
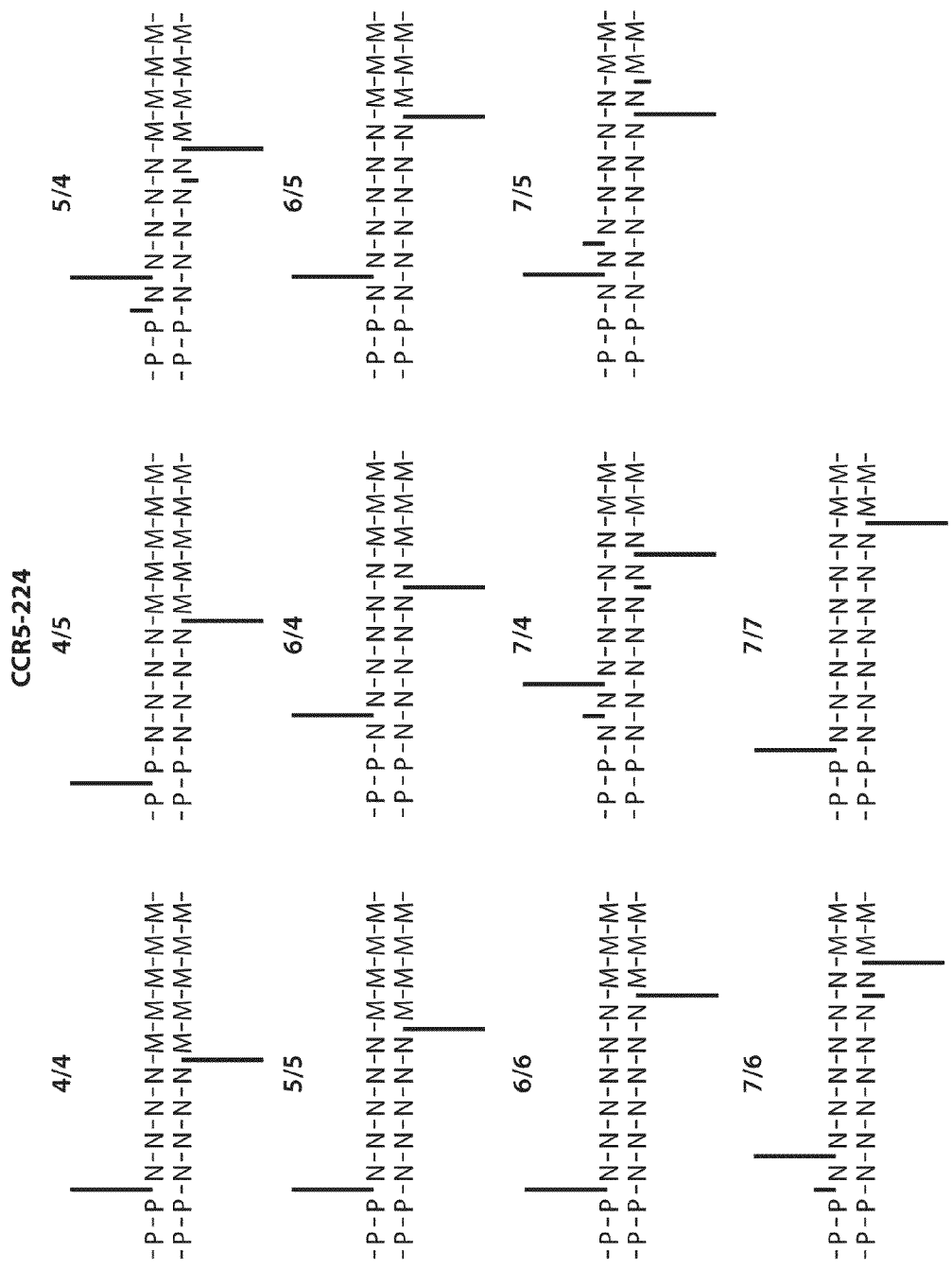
FIGS. 14A-B. ZFN cleavage occurs at characteristic locations in the DNA target site. The plots show the locations of cleavage sites identified in the in vitro selections with (a) 4 nM CCR5-224 or (b) 4 nM VF2468. The cleavage site locations show similar patterns for both ZFNs except in the case of five-base pair spacers with four-base overhangs. The titles refer to the spacer length/overhang length combination that is plotted (e.g., a site with a six base-pair spacer and a four base overhang is referred to as "6/4"). The black bars indicate the relative number of sequences cleaved for each combination of spacer length and overhang length. 'P' refers to nucleotides in the (+) target half-site, 'M' refers to nucleotides in the (−) target half site, and 'N' refers to nucleotides in the spacer. There were no "7/7" sequences from the 4 nM VF2468 selection. Only sequences with overhangs of at least 4 bases were tabulated.
Figure 14B:
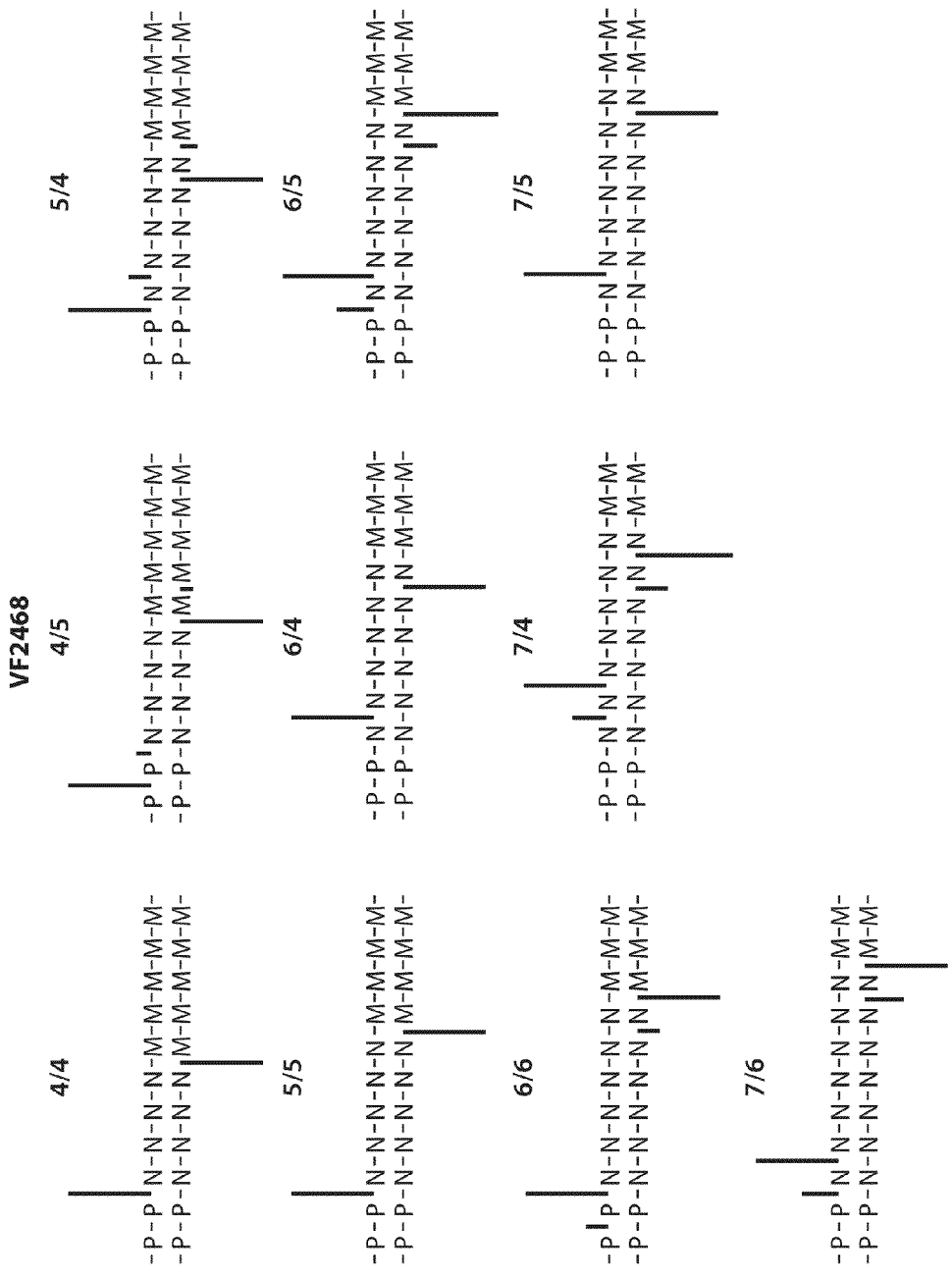
Figure 15A:
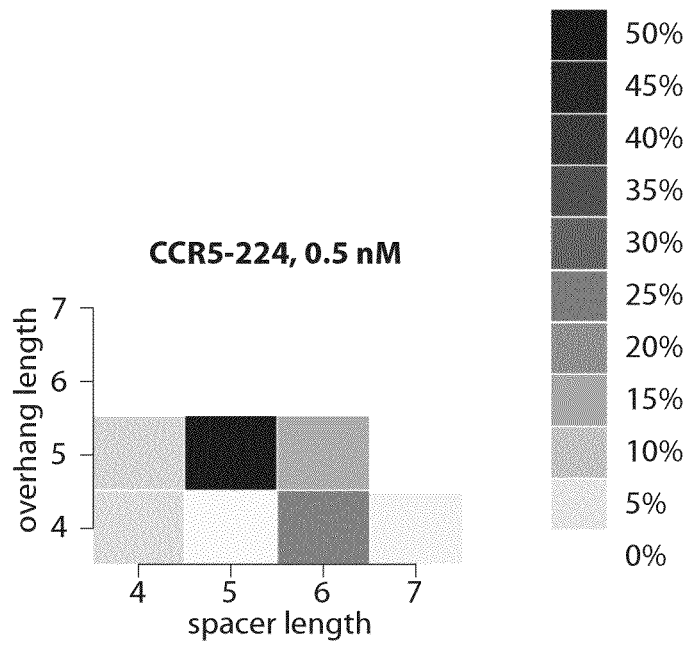
FIGS. 15A-D. CCR5-224 preferentially cleaves five- and six-base pair spacers and cleaves five-base pair spacers to leave five-nucleotide overhangs. The heat maps show the percentage of all sequences surviving each of the four CCR5-224 in vitro selections (a-d) that have the spacer and overhang lengths shown.
Figure 15B:
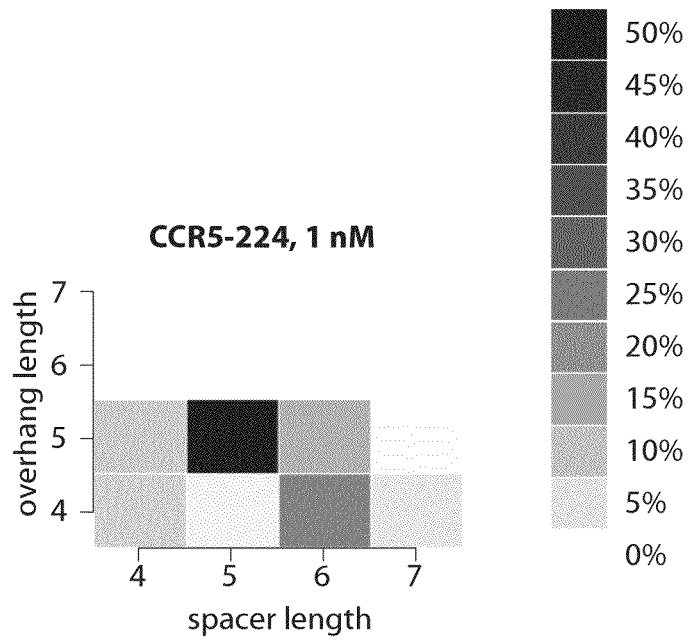
Figure 15C:
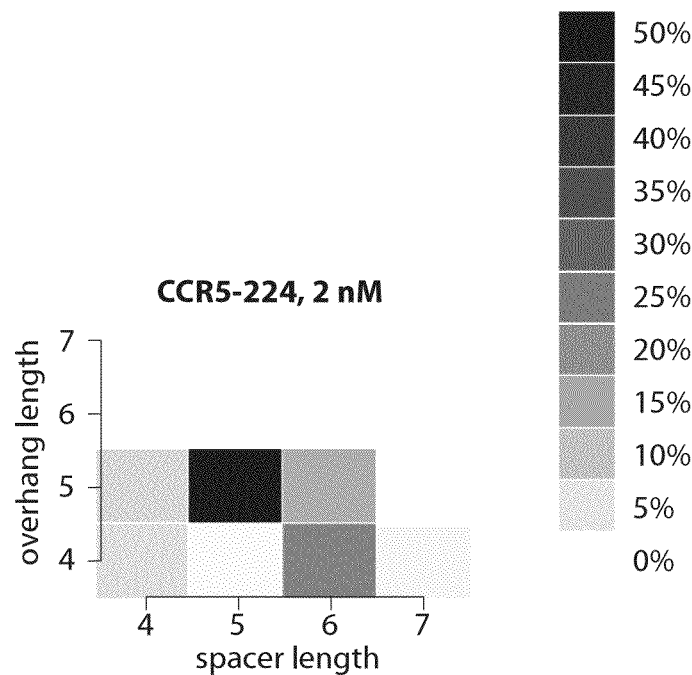
Figure 15D:
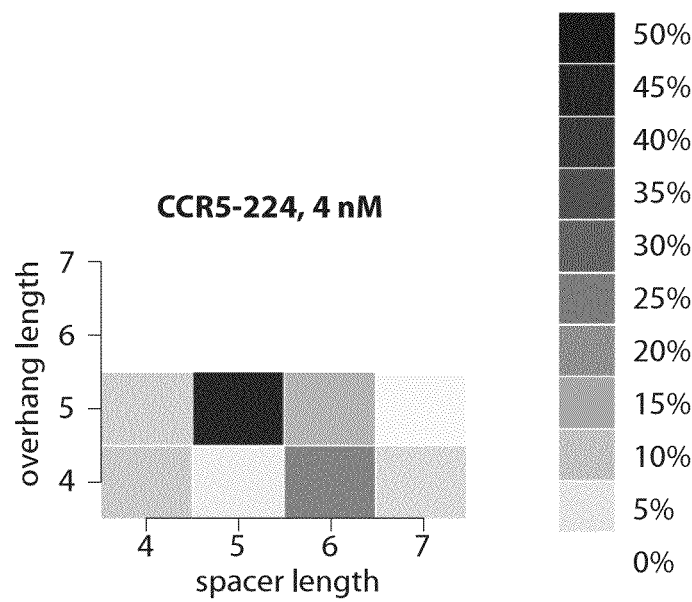
Figure 16A:
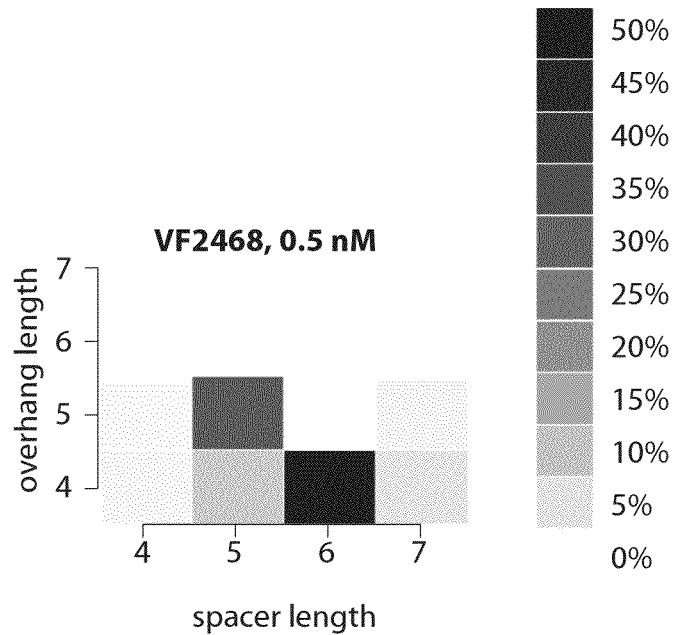
FIGS. 16A-D. VF2468 preferentially cleaves five- and six-base pair spacers, cleaves five-base pair spacers to leave five-nucleotide overhangs, and cleaves six-base pair spacers to leave four-nucleotide overhangs. The heat maps show the percentage of all sequences surviving each of the four VF2468 in vitro selections (a-d) that have the spacer and overhang lengths shown.
Figure 16B:
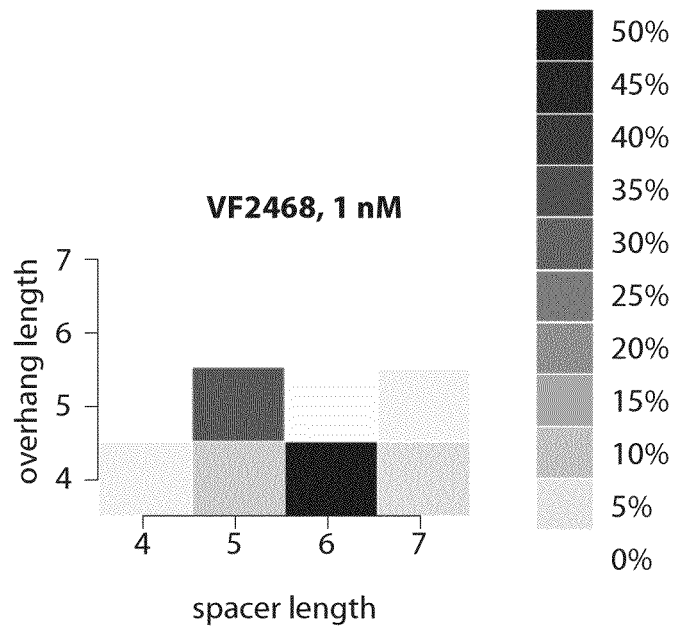
Figure 16C:
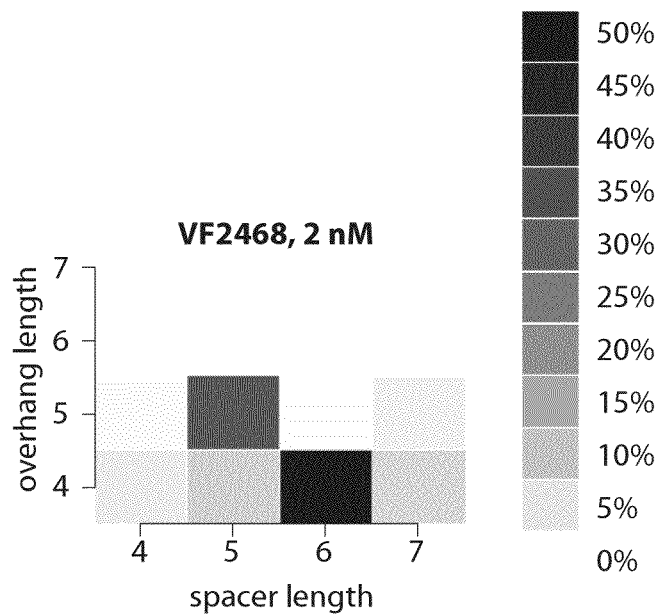
Figure 16D:
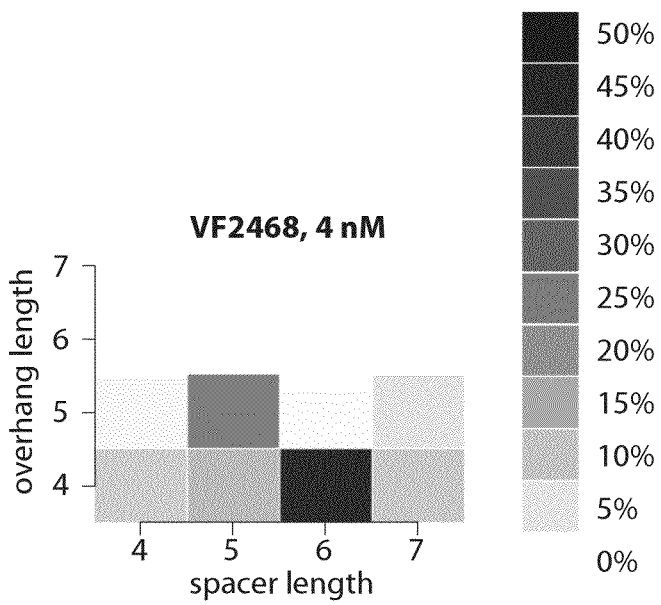
Figures 1, 17A:
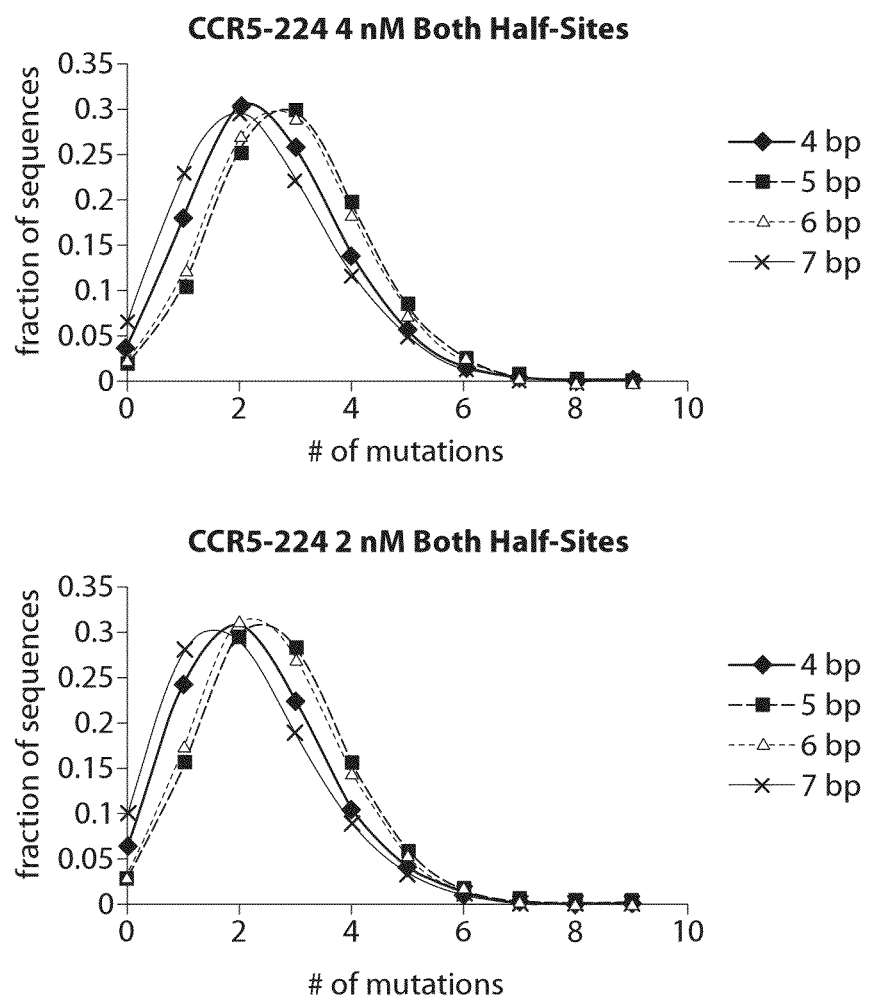
FIGS. 17A-F. ZFNs show spacer length-dependent sequence preferences. Both CCR5-224 (a-c) and VF2468 (d-f) show increased specificity for half-sites flanking four- and seven-base pair spacers than for half-sites flanking five- and six-base pair spacers. For both ZFNs, one half-site has a greater change in mutational tolerance than the other, and the change in mutational tolerance is concentration dependent.
Figures 2, 17A:
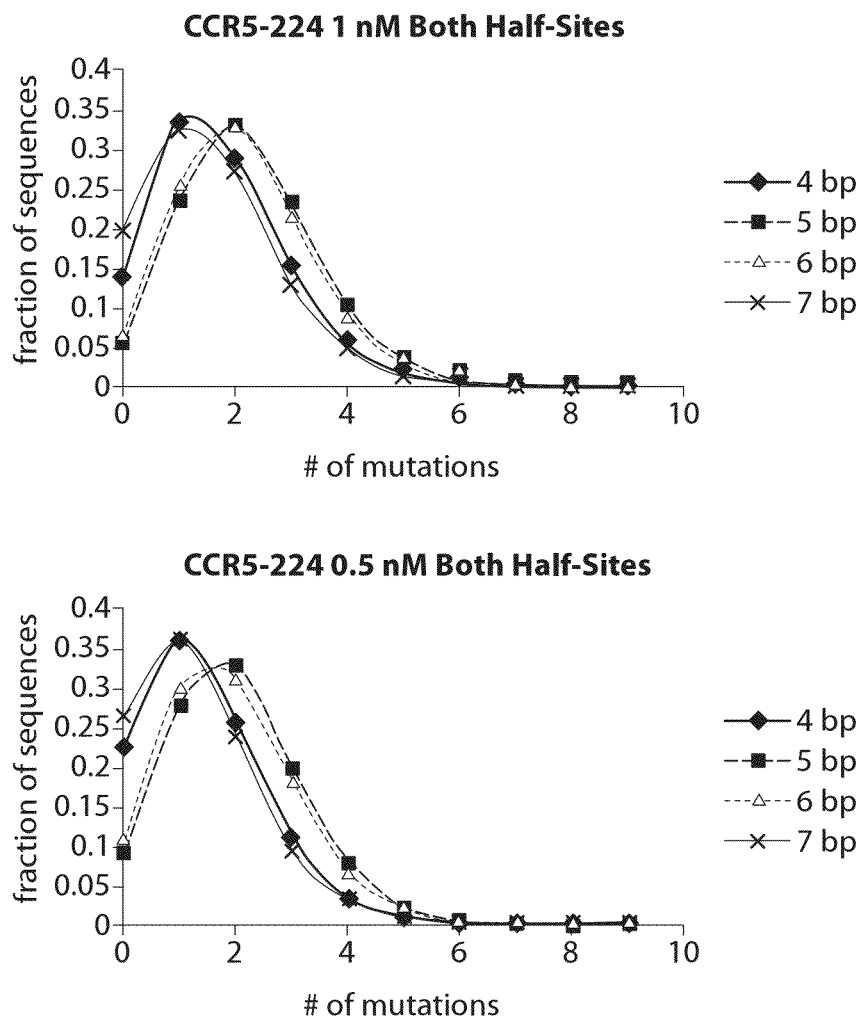
Figures 1, 17B:
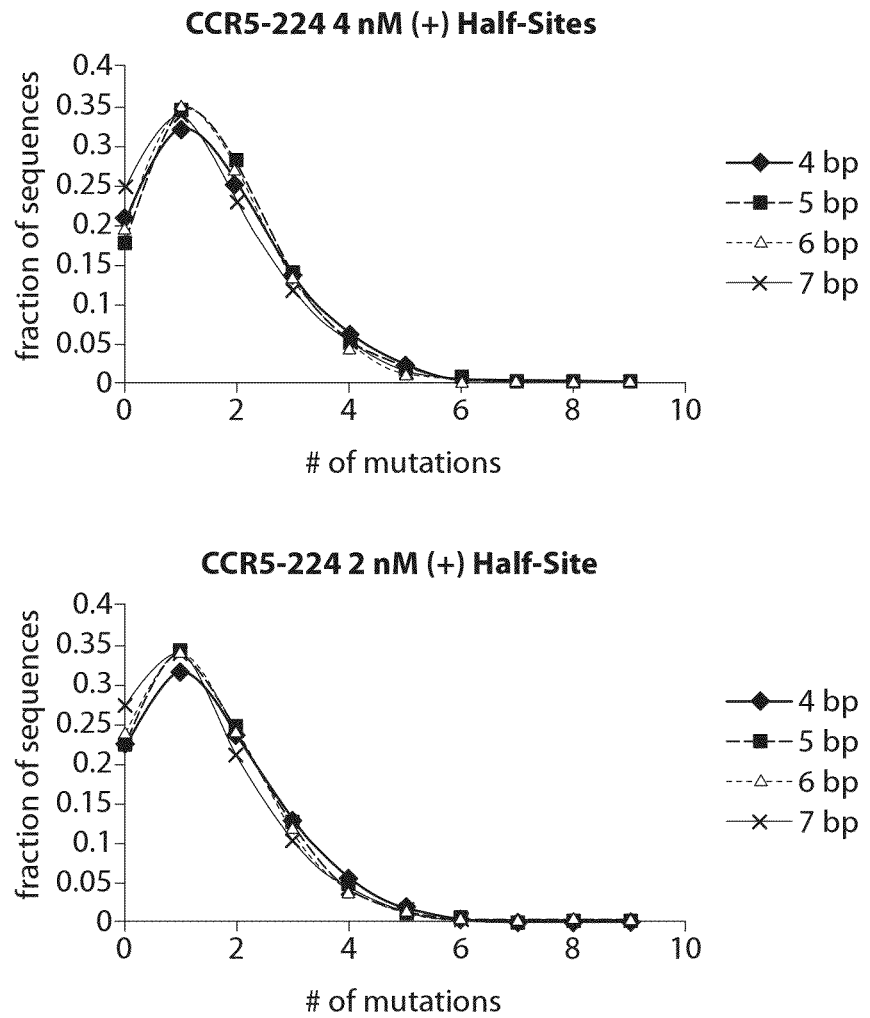
Figures 2, 17B:
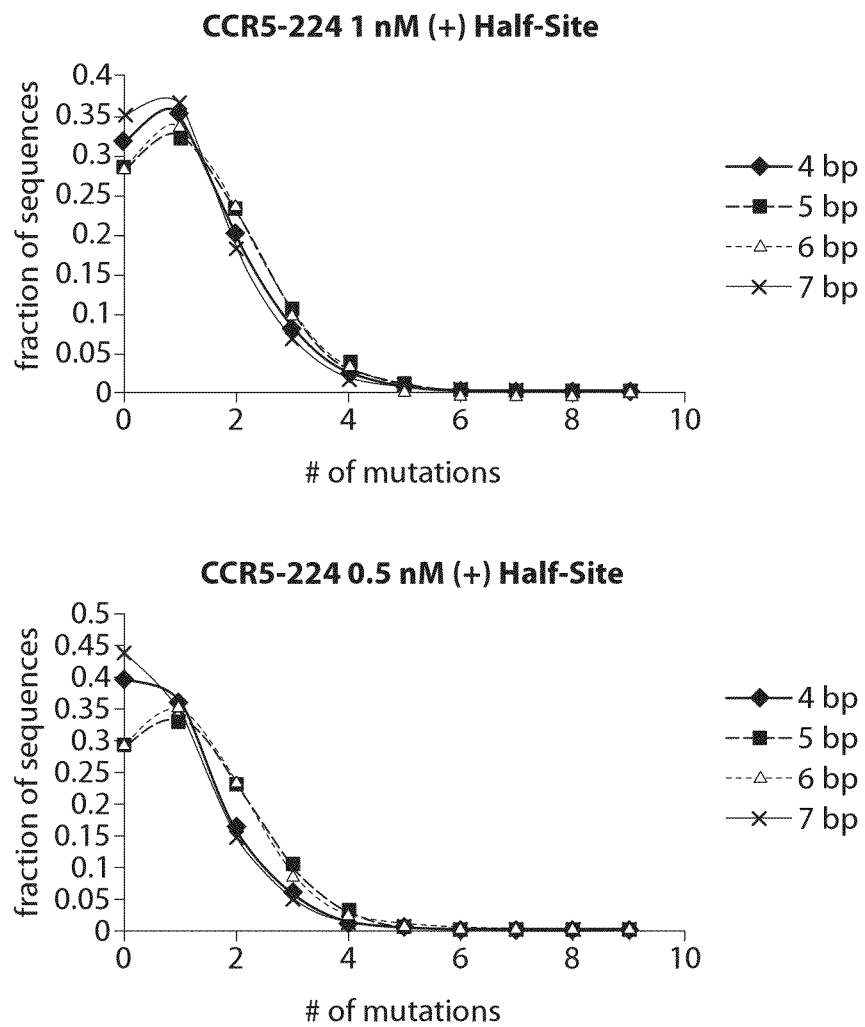
Figures 1, 17C:
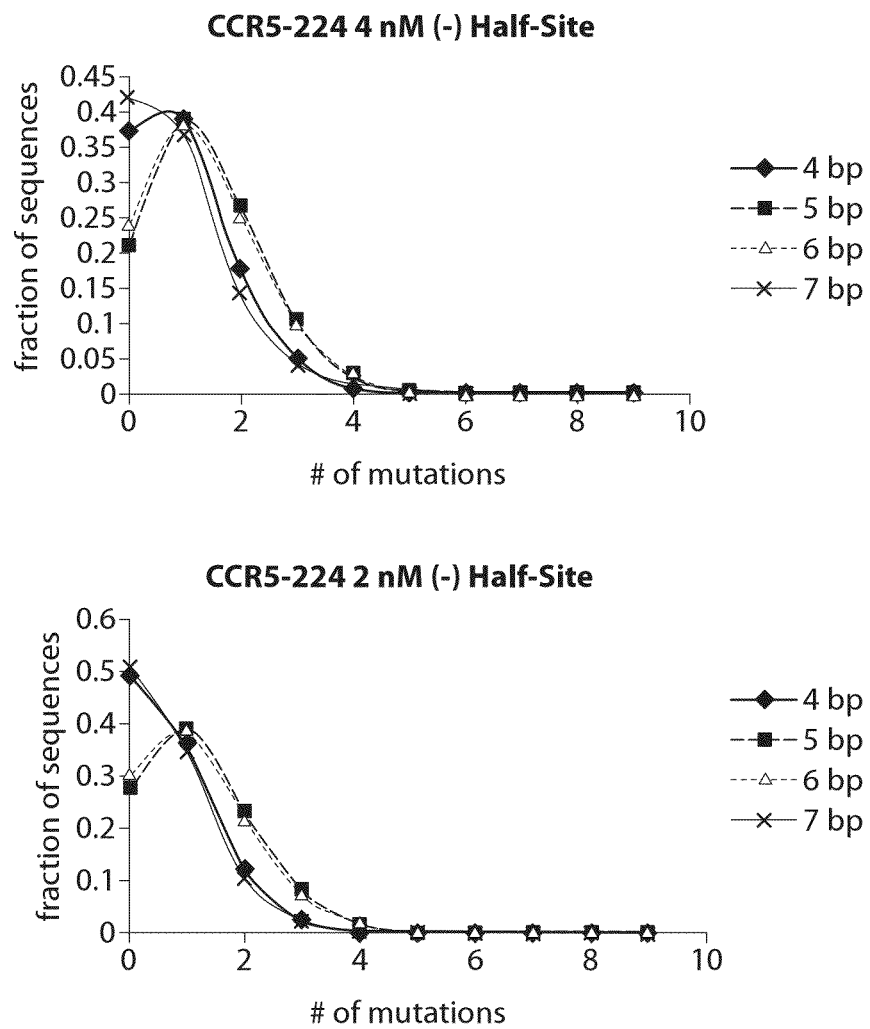
Figures 2, 17C:
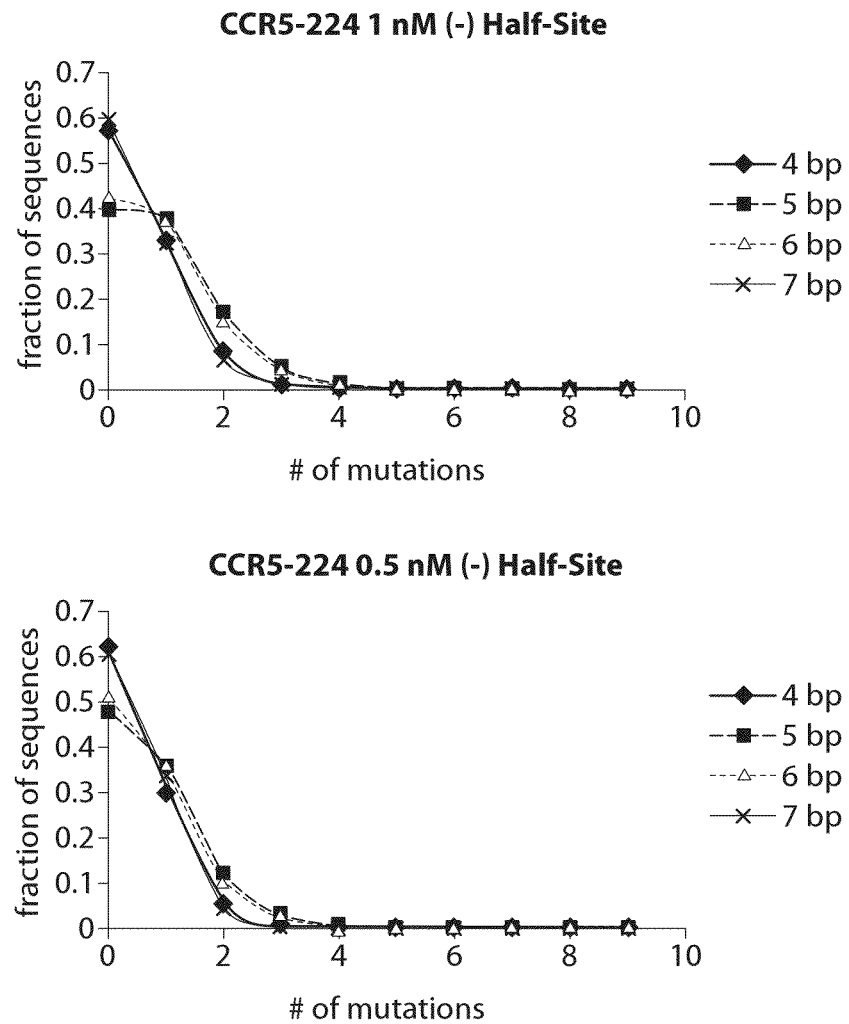
Figures 1, 17D:
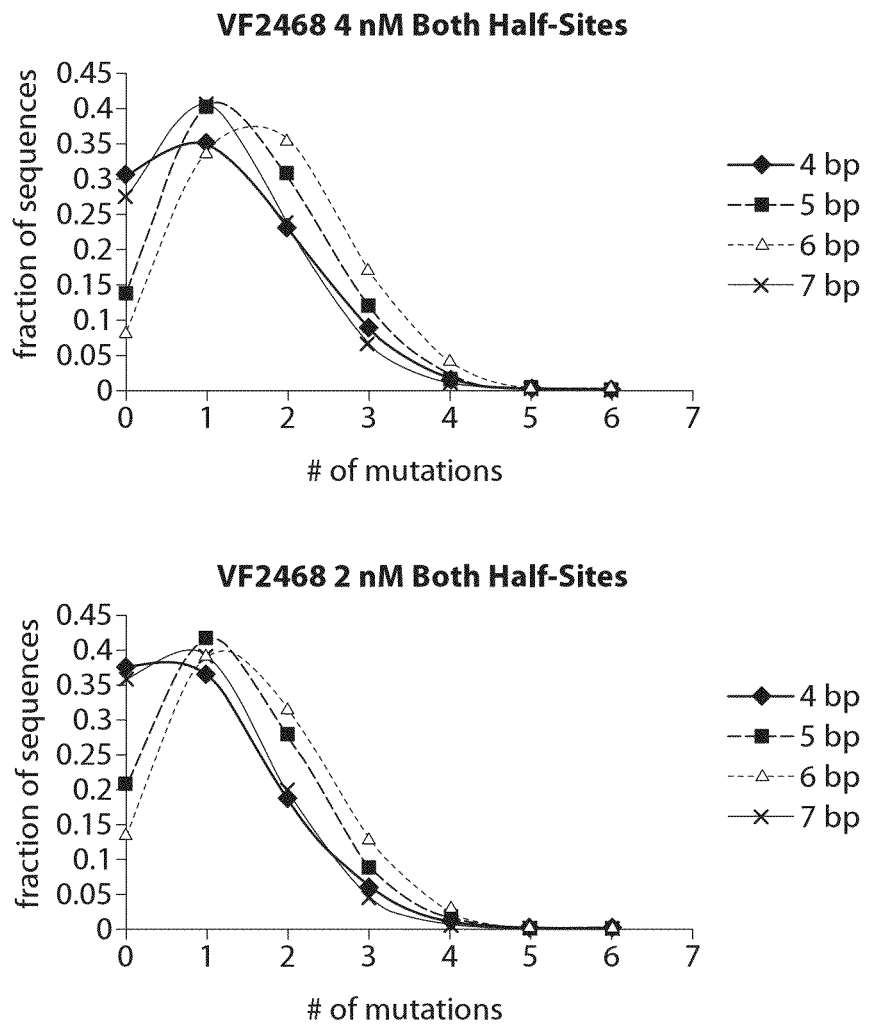
Figures 2, 17D:
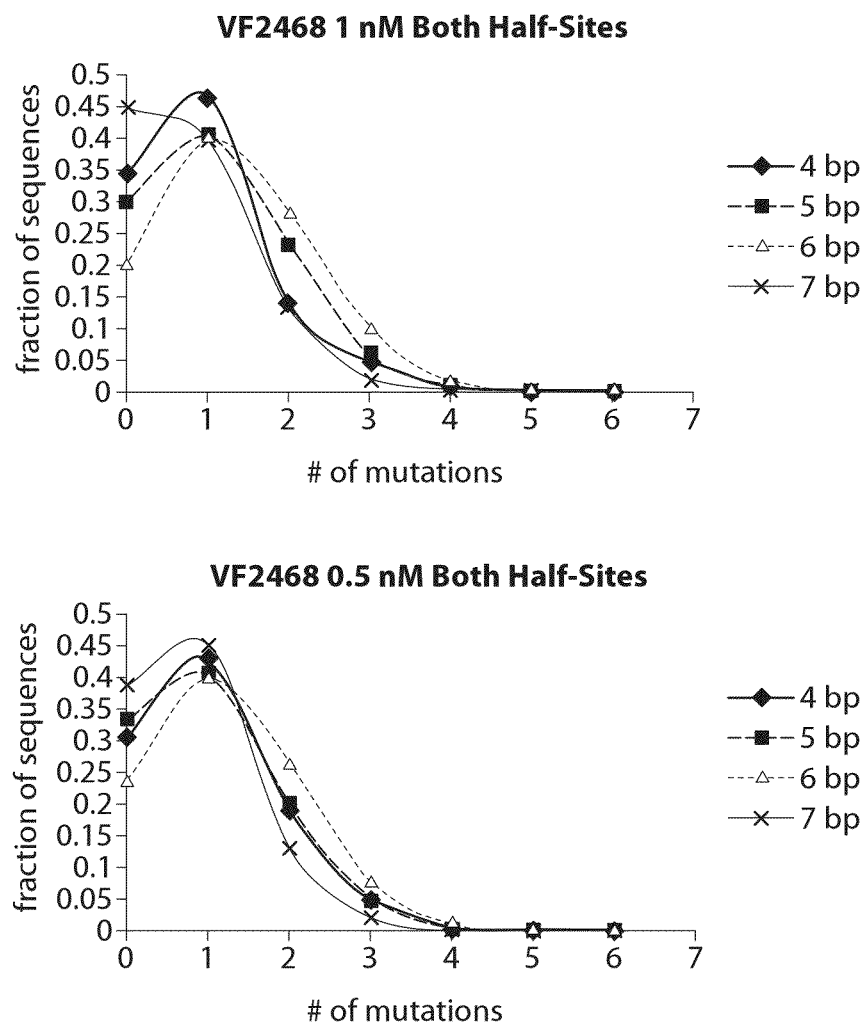
Figures 1, 17E:
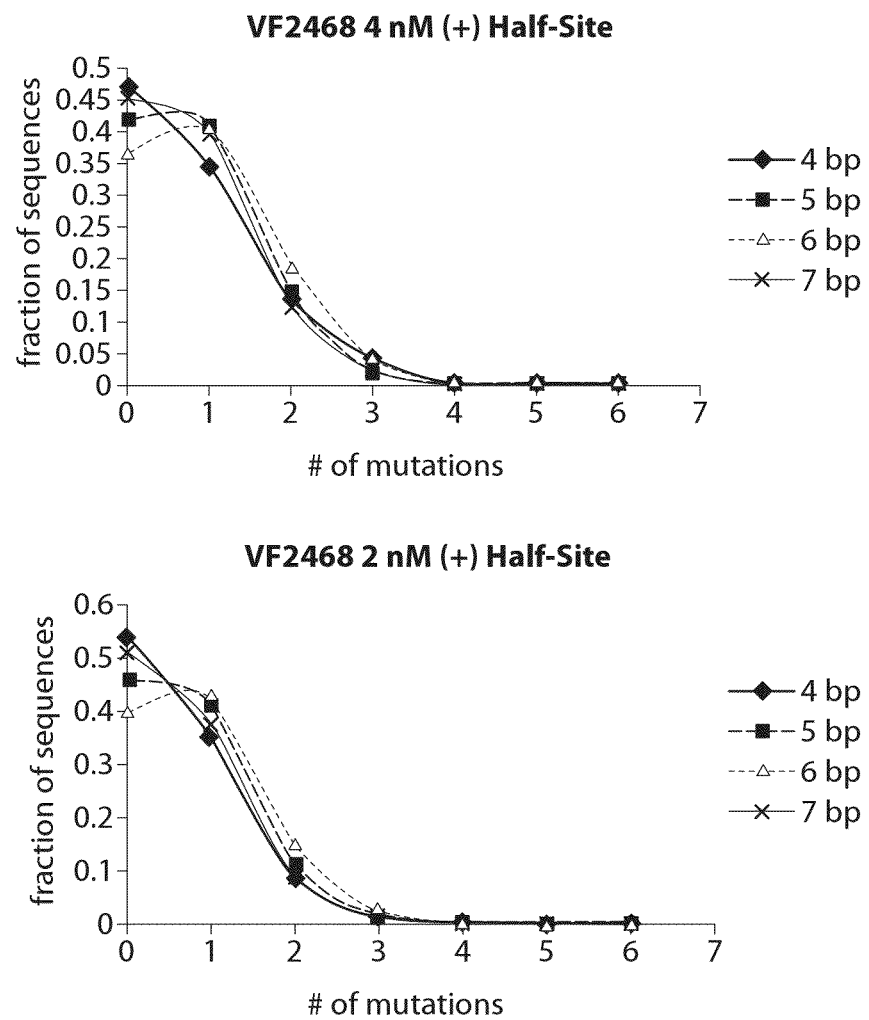
Figures 2, 17E:
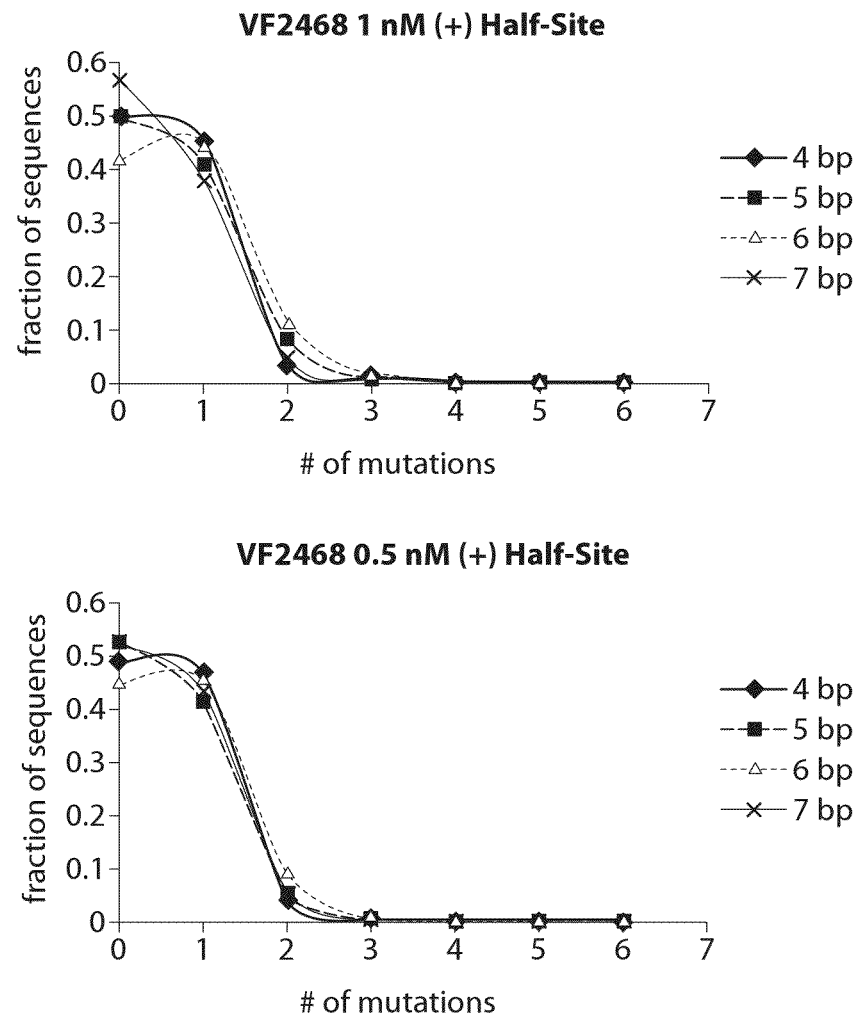
Figures 1, 17F:
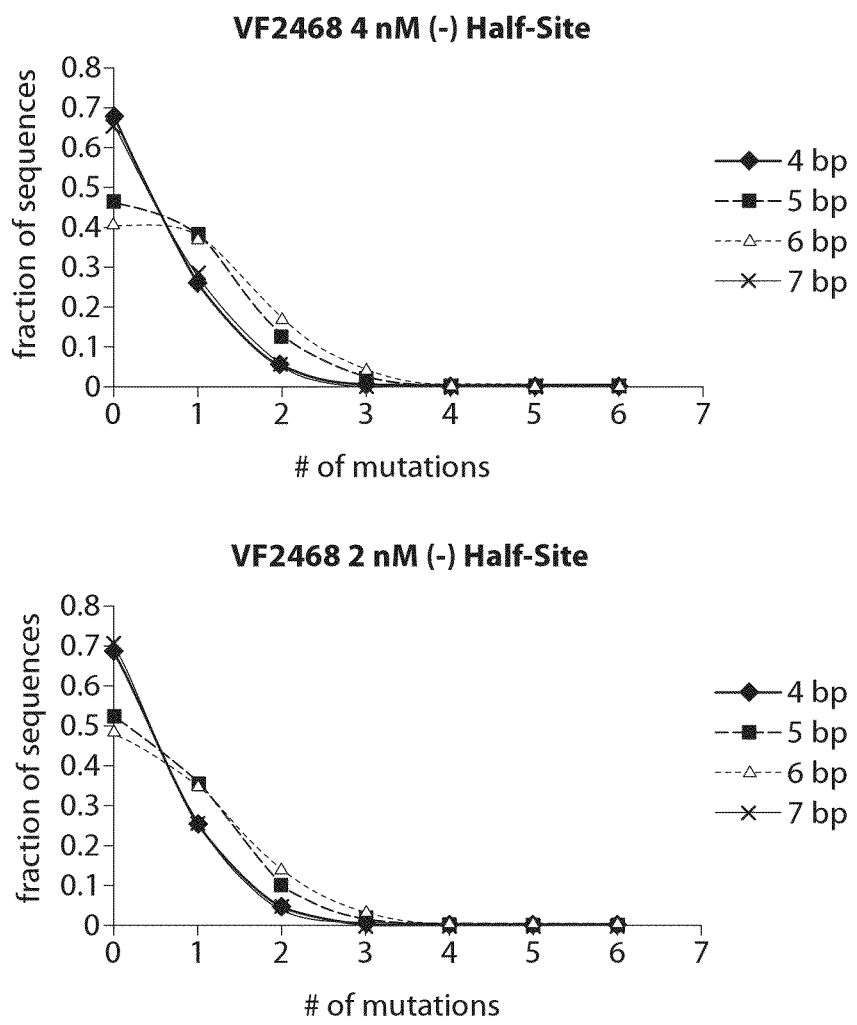
Figures 2, 17F:
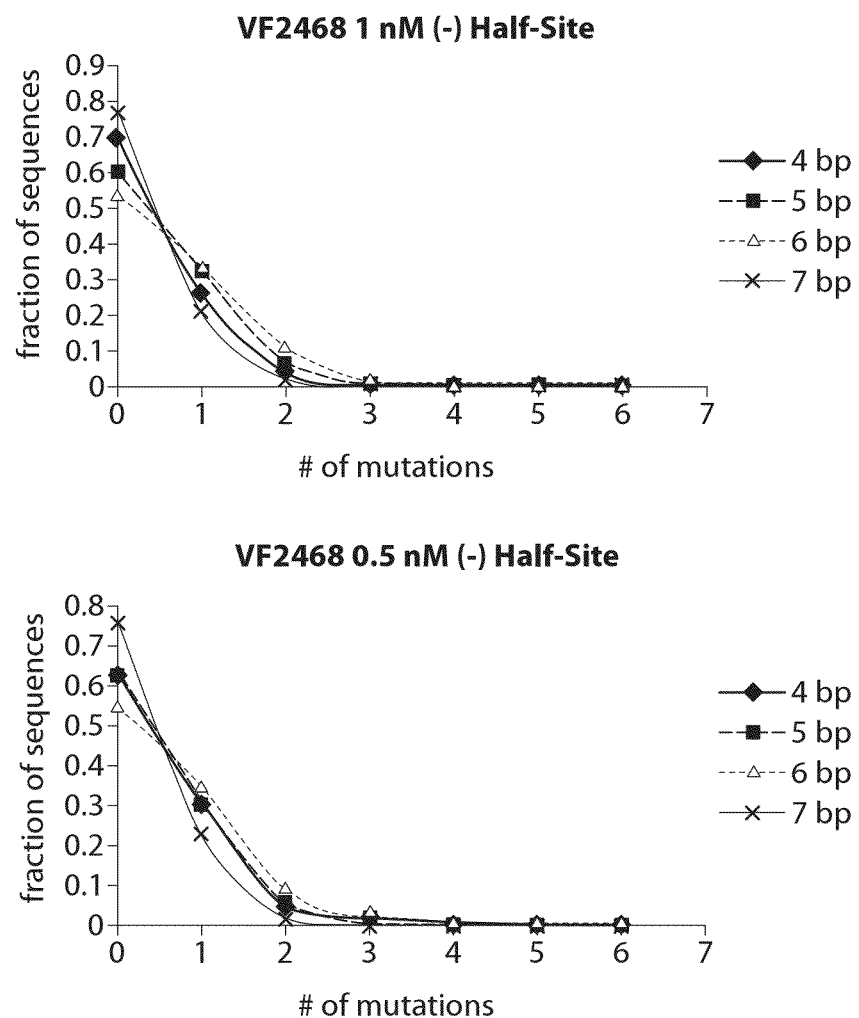
Figure 18:
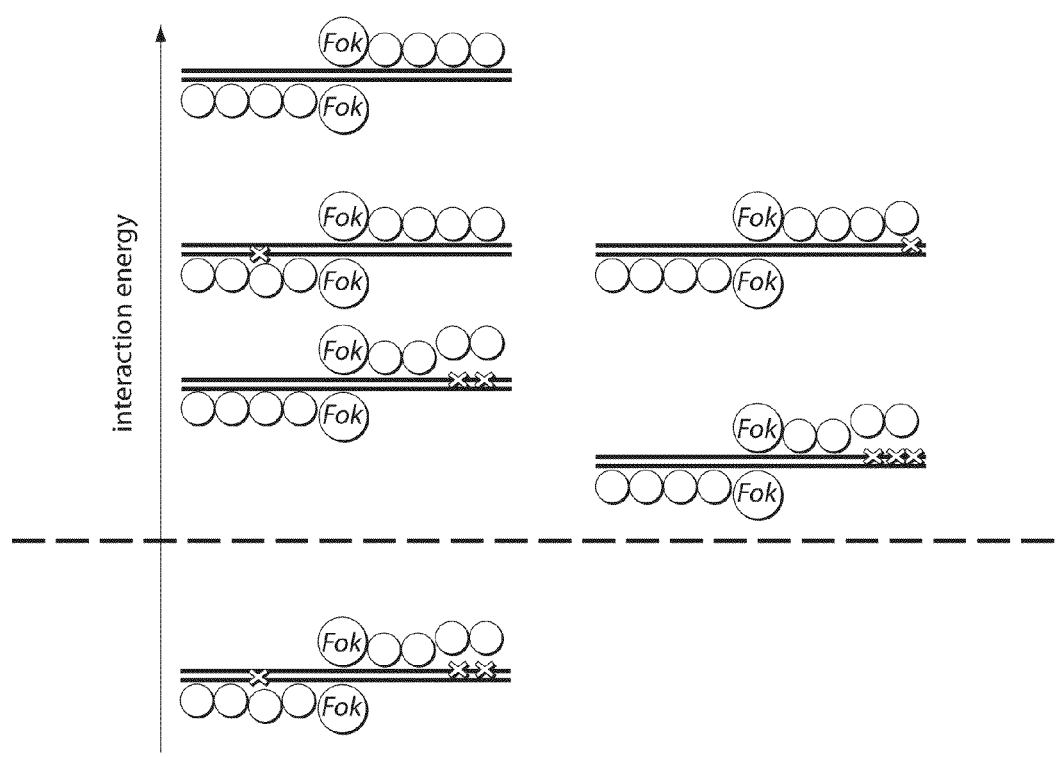
FIG. 18. Model for ZFN tolerance of off-target sequences. Our results suggest that some ZFNs recognize their intended target sites (top, black DNA strands with no Xs) with more binding energy than is required for cleavage under a given set of conditions (dotted line). Sequences with one or two mutations (one or two Xs) are generally tolerated since they do not decrease the ZFN:DNA binding energy below the threshold necessary for cleavage. Some sequences with additional mutations can still be cleaved if the additional mutations occur in regions of the zinc-finger binding interface that have already been disrupted (three Xs above the dotted line), as long as optimal interactions present at other locations in the ZFN:DNA binding interface maintain binding energies above threshold values. Additional mutations that disrupt key interactions at other locations in the ZFN:DNA interface, however, result in binding energies that fall short of the cleavage threshold.

This compensation model for ZFN site recognition applies not only to non-ideal half-sites, but also to spacers with non-ideal lengths. In general, the ZFNs cleaved at characteristic locations within the spacers (FIG. 14), and five- and six-base pair spacers were preferred over four- and seven-base pair spacers (FIGS. 15 and 16). However, cleaved sites with five- or six-base pair spacers showed greater sequence tolerance at the flanking half-sites than sites with four- or seven-base pair spacers (FIG. 17). Therefore, spacer imperfections, similar to half-site mutations, lead to more stringent in vitro recognition of other regions of the DNA substrate.

ZFNs can Cleave Many Sequences with Up to Three Mutations

Figure 4A:
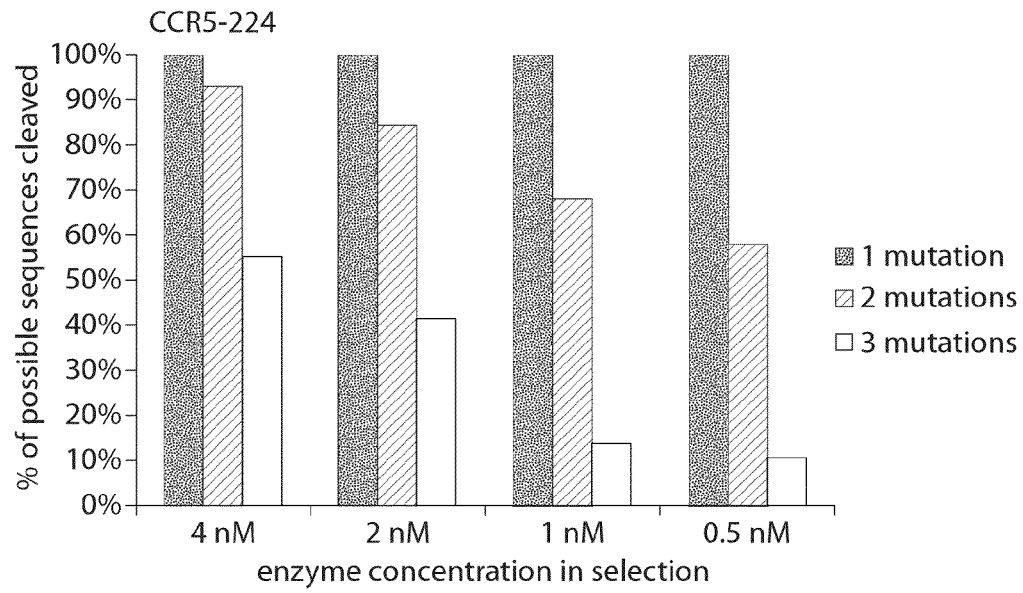
FIGS. 4A-B. ZFNs can cleave a large fraction of target sites with three or fewer mutations in vitro. The percentages of the sequences with one, two, or three mutations that are enriched for in vitro cleavage (enrichment factor>1) by the (a) CCR5-224 ZFN and (b) VF2468 ZFN are shown. Enrichment factors are calculated for each sequence identified in the selection by dividing the observed frequency of that sequence in the post-selection sequenced library by the frequency of that sequence in the pre-selection library.
Figure 4B:
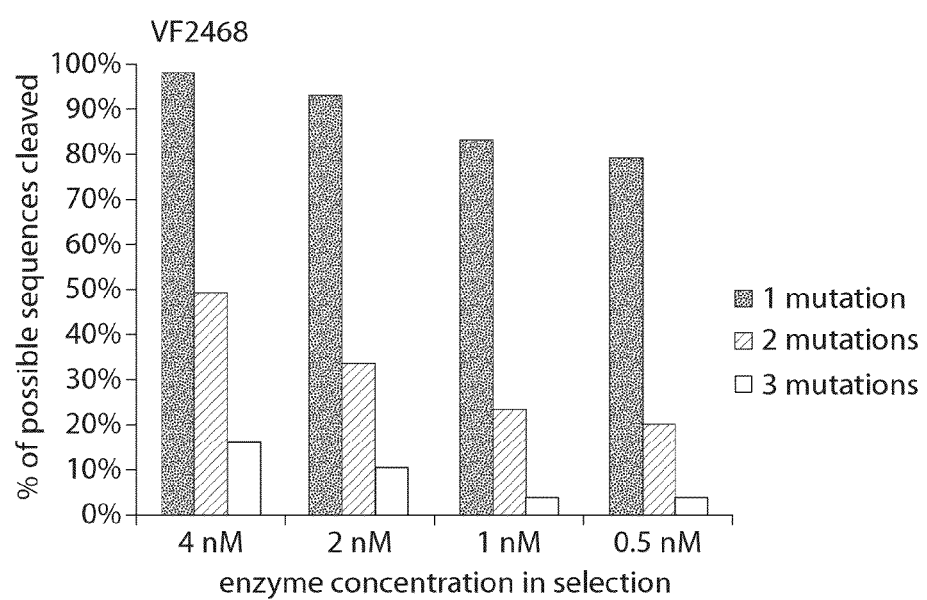

We calculated enrichment factors for all sequences containing three or fewer mutations by dividing each sequence's frequency of occurrence in the post-selection libraries by its frequency of occurrence in the pre-selection libraries. Among sequences enriched by cleavage (enrichment factor>1), CCR5-224 was capable of cleaving all unique single-mutant sequences, 93% of all unique double-mutant sequences, and half of all possible triple-mutant sequences (FIG. 4a and Table 3a) at the highest enzyme concentration used. VF2468 was capable of cleaving 98% of all unique single-mutant sequences, half of all unique double-mutant sequences, and 17% of all triple-mutant sequences (FIG. 4b and Table 3b).

Since our approach assays active ZFN dimers, it reveals the complete sequences of ZFN sites that can be cleaved. Ignoring the sequence of the spacer, the selection revealed 37 sites in the human genome with five- or six-base pair spacers that can be cleaved in vitro by CCR5-224 (Table 1 and Table 4), and 2,652 sites in the human genome that can be cleaved by VF2468 (VF2468 Data). Among the genomic sites that were cleaved in vitro by VF2468, 1,428 sites had three or fewer mutations relative to the canonical target site (excluding the spacer sequence). Despite greater discrimination against single-, double-, and triple-mutant sequences by VF2468 compared to CCR5-224 (FIG. 4 and Table 3), the larger number of in vitro-cleavable VF2468 sites reflects the difference in the number of sites in the human genome that are three or fewer mutations away from the VF2468 target site (3,450 sites) versus those that are three or fewer mutations away from the CCR5-224 target site (eight sites) (Table 5).

Identified Sites are Cleaved by ZFNs in Human Cells

We tested whether CCR5-224 could cleave at sites identified by our selections in human cells by expressing CCR5-224 in K562 cells and examining 34 potential target sites within the human genome for evidence of ZFN-induced mutations using PCR and high-throughput DNA sequencing. We defined sites with evidence of ZFN-mediated cleavage as those with insertion or deletion mutations (indels) characteristic of non-homologous end joining (NHEJ) repair (Table 6) that were significantly enriched (P<0.05) in cells expressing active CCR5-224 compared to control cells containing an empty vector. We obtained approximately 100,000 sequences or more for each site analyzed, which enabled the detection of sites that were significantly modified at frequencies of approximately 1 in 10,000. Our analysis identified ten such sites: the intended target sequence in CCR5, a previously identified sequence in CCR2, and eight other off-target sequences (Tables 1, 4, and 6), one of which lies within the promoter of the BTBD10 gene. The eight newly identified off-target sites are modified at frequencies ranging from 1 in 300 to 1 in 5,300. We also expressed VF2468 in cultured K562 cells and performed the above analysis for 90 of the most highly cleaved sites identified by in vitro selection. Out of the 90 VF2468 sites analyzed, 32 showed indels consistent with ZFN-mediated targeting in K562 cells (Table 7). We were unable to obtain site-specific PCR amplification products for three CCR5-224 sites and seven VF2468 sites and therefore could not analyze the occurrence of NHEJ at those loci. Taken together, these observations indicate that off-target sequences identified through the in vitro selection method include many DNA sequences that can be cleaved by ZFNs in human cells.

Discussion

The method presented here identified hundreds of thousands of sequences that can be cleaved by two active, dimeric ZFNs, including many that are present and can be cut in the genome of human cells. One newly identified cleavage site for the CCR5-224 ZFN is within the promoter of the BTBD10 gene. When downregulated, BTBD10 has been associated with malignancy[21] and with pancreatic beta cell apoptosis[22]. When upregulated, BTBD10 has been shown to enhance neuronal cell growth[23] and pancreatic beta cell proliferation through phosphorylation of Akt family proteins[22,23]. This potentially important off-target cleavage site as well as seven others we observed in cells were not identified in a recent study[6] that used in vitro monomer-binding data to predict potential CCR5-224 substrates.

We have previously shown that ZFNs that can cleave at sites in one cell line may not necessarily function in a different cell line[4], most likely due to local differences in chromatin structure. Therefore, it is likely that a different subset of the in vitro-cleavable off-target sites would be modified by CCR5-224 or VF2468 when expressed in different cell lines. Purely cellular studies of endonuclease specificity, such as a recent study of homing endonuclease off-target cleavage[24], may likewise be influenced by cell line choice. While our in vitro method does not account for some features of cellular DNA, it provides general, cell type-independent information about endonuclease specificity and off-target sites that can inform subsequent studies performed in cell types of interest. In addition, while our pre-selection library oversamples with at least 10-fold coverage all sequences within seven mutations of the intended ZFN target sites, the number of sequence reads obtained per selection (approximately one million) is likely insufficient to cover all cleaved sequences present in the post-selection libraries. It is therefore possible that additional off-target cleavage sites for CCR5-224 and VF2468 could be identified in the human genome as sequencing capabilities continue to improve.

Although both ZFNs we analyzed were engineered to a unique sequence in the human genome, both cleave a significant number of off-target sites in cells. This finding is particularly surprising for the four-finger CCR5-224 pair given that its theoretical specificity is 4,096-fold better than that of the three-finger VF2468 pair (CCR5-224 should recognize a 24-base pair site that is six base pairs longer than the 18-base pair VF2468 site). Examination of the CCR5-224 and VF2468 cleavage profiles (FIG. 2) and mutational tolerances of sequences with three or fewer mutations (FIG. 4) suggests different strategies may be required to engineer variants of these ZFNs with reduced off-target cleavage activities. The four-finger CCR5-224 ZFN showed a more diffuse range of positions with relaxed specificity and a higher tolerance of mutant sequences with three or fewer mutations than the three-finger VF2468 ZFN. For VF2468, re-optimization of only a subset of fingers may enable a substantial reduction in undesired cleavage events. For CCR5-224, in contrast, a more extensive re-optimization of many or all fingers may be required to eliminate off-target cleavage events.

We note that not all four- and three-finger ZFNs will necessarily be as specific as the two ZFNs tested in this study. Both CCR5-224 and VF2468 were engineered using methods designed to optimize the binding activity of the ZFNs. Previous work has shown that for both three-finger and four-finger ZFNs, the specific methodology used to engineer the ZFN pair can have a tremendous impact on the quality and specificity of nucleases[7,13,25,26].

Our findings have significant implications for the design and application of ZFNs with increased specificity. Half or more of all potential substrates with one or two site mutations could be cleaved by ZFNs, suggesting that binding affinity between ZFN and DNA substrate is sufficiently high for cleavage to occur even with suboptimal molecular interactions at mutant positions. We also observed that ZFNs presented with sites that have mutations in one half-site exhibited higher mutational tolerance at other positions within the mutated half-site and lower tolerance at positions in the other half-site. These results collectively suggest that in order to meet a minimum affinity threshold for cleavage, a shortage of binding energy from a half-site harboring an off-target base pair must be energetically compensated by excess zinc finger: DNA binding energy in the other half-site, which demands increased sequence recognition stringency at the non-mutated half-site (FIG. S18). Conversely, the relaxed stringency at other positions in mutated half-sites can be explained by the decreased contribution of that mutant half-site to overall ZFN binding energy. This hypothesis is supported by a recent study showing that reducing the number of zinc fingers in a ZFN can actually increase, rather than decrease, activity[27].

This model also explains our observation that sites with suboptimal spacer lengths, which presumably were bound less favorably by ZFNs, were recognized with higher stringency than sites with optimal spacer lengths. In vitro spacer preferences do not necessarily reflect spacer preferences in cells;[28,29] however, our results suggest that the dimeric FokI cleavage domain can influence ZFN target-site recognition. Consistent with this model, Wolfe and co-workers recently observed differences in the frequency of off-target events in zebrafish of two ZFNs with identical zinc-finger domains but different FokI domain variants.[20]

Collectively, our findings suggest that (i) ZFN specificity can be increased by avoiding the design of ZFNs with excess DNA binding energy; (ii) off-target cleavage can be minimized by designing ZFNs to target sites that do not have relatives in the genome within three mutations; and (iii) ZFNs should be used at the lowest concentrations necessary to cleave the target sequence to the desired extent. While this study focused on ZFNs, our method should be applicable to all sequence-specific endonucleases that cleave DNA in vitro, including engineered homing endonucleases and engineered transcription activator-like effector (TALE) nucleases. This approach can provide important information when choosing target sites in genomes for sequence-specific endonucleases, and when engineering these enzymes, especially for therapeutic applications.

Methods

Oligonucleotides and Sequences. All oligonucleotides were purchased from Integrated DNA Technologies or Invitrogen and are listed in Table 8. Primers with degenerate positions were synthesized by Integrated DNA Technologies using hand-mixed phosphoramidites containing 79% of the indicated base and 7% of each of the other standard DNA bases.

Sequences of ZFNs used in this study. DNA and protein sequences are shown for the ZFNs used in this study. The T7 promoter is underlined, and the start codon is in bold.

```
CCR5-224 (+) DNA sequence (SEQ ID NO: 119):
TAATACGACTCACTATAGGGAGACCCAAGCTGGCTAGCCACCATGGACTACAAAGACCATGACGGTGATTATAAA

GATCATGACATCGATTACAAGGATGACGATGACAAGATGGCCCCCAAGAAGAAGAGGAAGGTGGGCATTCACGGG

GTACCCGCCGCTATGGCTGAGAGGCCCTTCCAGTGTCGAATCTGCATGCGTAACTTCAGTGATCGCTCTAACCTG

AGTCGGCACATCCGCACCCACACAGGCGAGAAGCCTTTTGCCTGTGACATTTGTGGGAGGAAGTTTGCCATCTCC

TCCAACCTGAACTCCCATACCAAGATACACACGGGATCTCAGAAGCCCTTCCAGTGTCGAATCTGCATGCGTAAC

TTCAGTCGCTCCGACAACCTGGCCCGCCACATCCGCACCCACACAGGCGAGAAGCCTTTTGCCTGTGACATTTGT

GGGAGGAAATTTGCCACCTCCGGCAACCTGACCCGCCATACCAAGATACACCTGCGGGGATCCCAACTAGTCAAA

AGTGAACTGGAGGAGAAGAAATCTGAACTTCGTCATAAATTGAAATATGTGCCTCATGAATATATTGAATTAATT

GAAATTGCCAGAAATTCCACTCAGGATAGAATTCTTGAAATGAAGGTAATGGAATTTTTTATGAAAGTTTATGGA

TATAGAGGTAAACATTTGGGTGGATCAAGGAAACCGGACGGAGCAATTTATACTGTCGGATCTCCTATTGATTAC

GGTGTGATCGTGGATACTAAAGCTTATAGCGGAGGTTATAATCTGCCAATTGGCCAAGCAGATGAAATGCAACGA

TATGTCAAAGAAAATCAAACACGAAACAAACATATCAACCCTAATGAATGGTGGAAAGTCTATCCATCTTCTGTA

ACGGAATTTAAGTTTTTATTTGTGAGTGGTCACTTTAAAGGAAACTACAAAGCTCAGCTTACACGATTAAATCAT

AAGACTAATTGTAATGGAGCTGTTCTTAGTGTAGAAGAGCTTTTAATTGGTGGAGAAATGATTAAAGCCGGCACA

TTAACCTTAGAGGAAGTGAGACGGAAATTTAATAACGGCGAGATAAACTTTTAA

CCR5-224 (+) protein sequence (SEQ ID NO: 120):
MDYKDHDGDYKDHDIDYKDDDDKMAPKKKRKVGIHGVPAAMAERPFQCRICMRNFSDRSNLSRHIRTHTGEKPFA

CDICGRKFAISSNLNSHTKIHTGSQKPFQCRICMRNFSRSDNLARHIRTHTGEKPFACDICGRKFATSGNLTRHT

KIHLRGSQLVKSELEEKKSELRHKLKYVPHEYIELIEIARNSTQDRILEMKVMEFFMKVYGYRGKHLGGSRKPDG

AIYTVGSPIDYGVIVDTKAYSGGYNLPIGQADEMQRYVKENQTRNKHINPNEWWKVYPSSVTEFKFLFVSGHFKG

NYKAQLTRLNHKTNCNGAVLSVEELLIGGEMIKAGTLTLEEVRRKFNNGEINF

CCR5-224 (-) DNA sequence (SEQ ID NO: 121):
TAATACGACTCACTATAGGGAGACCCAAGCTGGCTAGCCACCATGGACTACAAAGACCATGACGGTGATTATAAA

GATCATGACATCGATTACAAGGATGACGATGACAAGATGGCCCCCAAGAAGAAGAGGAAGGTGGGCATTCACGGG
```

-continued

```
GTACCTGCCGCTATGGCTGAGAGGCCCTTCCAGTGTCGAATCTGCATGCGTAACTTCAGTCGCTCCGACAACCTG

TCCGTGCACATCCGCACCCACACAGGCGAGAAGCCTTTTGCCTGTGACATTTGTGGGAGGAAGTTTGCCCAGAAG

ATCAACCTGCAGGTGCATACCAAGATACACACCGGCGAGAAGCCCTTCCAGTGTCGAATCTGCATGCGTAACTTC

AGTCGCTCCGACGTGCTGTCCGAGCACATCCGCACCCACACAGGCGAGAAGCCTTTTGCCTGTGACATTTGTGGG

AGGAAATTTGCCCAGCGCAACCACCGCACCACCCATACCAAGATACACCTGCGGGGATCCCAACTAGTCAAAAGT

GAACTGGAGGAGAAGAAATCTGAACTTCGTCATAAATTGAAATATGTGCCTCATGAATATATTGAATTAATTGAA

ATTGCCAGAAATTCCACTCAGGATAGAATTCTTGAAATGAAGGTAATGGAATTTTTTATGAAAGTTTATGGATAT

AGAGGTAAACATTTGGGTGGATCAAGGAAACCGGACGGAGCAATTTATACTGTCGGATCTCCTATTGATTACGGT

GTGATCGTGGATACTAAAGCTTATAGCGGAGGTTATAATCTGCCAATTGGCCAAGCAGATGAAATGGAGCGATAT

GTCGAAGAAAATCAAACACGAAACAAACATCTCAACCCTAATGAATGGTGGAAAGTCTATCCATCTTCTGTAACG

GAATTTAAGTTTTTATTTGTGAGTGGTCACTTTAAAGGAAACTACAAAGCTCAGCTTACACGATTAAATCATATC

ACTAATTGTAATGGAGCTGTTCTTAGTGTAGAAGAGCTTTTAATTGGTGGAGAAATGATTAAAGCCGGCACATTA

ACCTTAGAGGAAGTGAGACGGAAATTTAATAACGGCGAGATAAACTTTTAA
```

CCR5-224 (-) protein sequence (SEQ ID NO: 122):
MDYKDHDGDYKDHDIDYKDDDDKMAPKKKRKVGIHGVPAAMAERPFQCRICMRNFSRSDNLSVHIR

THTGEKPFACDICGRKFAQKINLQVHTKIHTGEKPFQCRICMRNFSRSDVLSEHIRTHTGEKPFACDICG

RKFAQRNHRTTHTKIHLRGSQLVKSELEEKKSELRHKLKYVPHEYIELIEIARNSTQDRILEMKVMEFF

MKVYGYRGKHLGGSRKPDGAIYTVGSPIDYGVIVDTKAYSGGYNLPIGQADEMERYVEENQTRNKHL

NPNEWWKVYPSSVTEFKFLFVSGHFKGNYKAQLTRLNHITNCNGAVLSVEELLIGGEMIKAGTLTLEE

VRRKFNNGEINF

VF2468 (+) DNA sequence (SEQ ID NO: 123):
<u>TAATACGACTCACTATAGG</u>GAGACCCAAGCTGGCTAGCCACCATGGACTACAAAGACCATGACGG

```
TGATTATAAAGATCATGACATCGATTACAAGGATGACGATGACAAGATGGCCCCCAAGAAGAAGA

GGAAGGTGGGCATTCACGGGGTGCCGTCTAGACCCGGGGAGCGCCCCTTCCAGTGTCGCATTTGC

ATGCGGAACTTTTCGCGCCAGGACAGGCTTGACAGGCATACCCGTACTCATACCGGTGAAAAACC

GTTTCAGTGTCGGATCTGTATGCGAAATTTCTCCCAGAAGGAGCACTTGGCGGGCATCTACGTAC

GCACACCGGCGAGAAGCCATTCCAATGCCGAATATGCATGCGCAACTTCAGTCGCCGCGACAACC

TGAACCGGCACCTAAAAACCCACCTGAGGGGATCCCAACTAGTCAAAAGTGAACTGGAGGAGAA

GAAATCTGAACTTCGTCATAAATTGAAATATGTGCCTCATGAATATATTGAATTAATTGAAATTGC

CAGAAATTCCACTCAGGATAGAATTCTTGAAATGAAGGTAATGGAATTTTTTATGAAAGTTTATGG

ATATAGAGGTAAACATTTGGGTGGATCAAGGAAACCGGACGGAGCAATTTATACTGTCGGATCTC

CTATTGATTACGGTGTGATCGTGGATACTAAAGCTTATAGCGGAGGTTATAATCTGCCAATTGGCC

AAGCAGATGAAATGCAACGATATGTCAAAGAAAATCAAACACGAAACAAACATATCAACCCTAAT

GAATGGTGGAAAGTCTATCCATCTTCTGTAACGGAATTTAAGTTTTTATTTGTGAGTGGTCACTTTA

AAGGAAACTACAAAGCTCAGCTTACACGATTAAATCATAAGACTAATTGTAATGGAGCTGTTCTTA

GTGTAGAAGAGCTTTTAATTGGTGGAGAAATGATTAAAGCCGGCACATTAACCTTAGAGGAAGTG

AGACGGAAATTTAATAACGGCGAGATAAACTTTTAA
```

VF2468 (+) protein sequence (SEQ ID NO: 124):
MDYKDHDGDYKDHDIDYKDDDDKMAPKKKRKVGIHGVPSRPGERPFQCRICMRNFSRQDRLDRHTR

THTGEKPFQCRICMRNFSQKEHLAGHLRTHTGEKPFQCRICMRNFSRRDNLNRHLKTHLRGSQLVKSE

LEEKKSELRHKLKYVPHEYIELIEIARNSTQDRILEMKVMEFFMKVYGYRGKHLGGSRKPDGAIYTVGS

```
                                         -continued
PIDYGVIVDTKAYSGGYNLPIGQADEMQRYVKENQTRNKHINPNEWWKVYPSSVTEFKFLFVSGHFKG

NYKAQLTRLNHKTNCNGAVLSVEELLIGGEMIKAGTLTLEEVRRKFNNGEINF

VF2468 (-) DNA sequence (SEQ ID NO: 125):
TAATACGACTCACTATAGGGAGACCCAAGCTGGCTAGCCACCATGGACTACAAAGACCATGACGG

TGATTATAAAGATCATGACATCGATTACAAGGATGACGATGACAAGATGGCCCCCAAGAAGAAGA

GGAAGGTGGGCATTCACGGGGTGCCGTCTAGACCCGGGGAGCGCCCCTTCCAGTGTCGCATTTGC

ATGCGGAACTTTTCGACCGGCCAGATCCTTGACCGCCATACCCGTACTCATACCGGTGAAAAACCG

TTTCAGTGTCGGATCTGTATGCGAAATTTCTCCGTGGCGCACAGCTTGAAGAGGCATCTACGTACG

CACACCGGCGAGAAGCCATTCCAATGCCGAATATGCATGCGCAACTTCAGTGACCCCAGCAACCT

GCGGCGCCACCTAAAAACCCACCTGAGGGGATCCCAACTAGTCAAAAGTGAACTGGAGGAGAAG

AAATCTGAACTTCGTCATAAATTGAAATATGTGCCTCATGAATATATTGAATTAATTGAAATTGCC

AGAAATTCCACTCAGGATAGAATTCTTGAAATGAAGGTAATGGAATTTTTTATGAAAGTTTATGGA

TATAGAGGTAAACATTTGGGTGGATCAAGGAAACCGGACGGAGCAATTTATACTGTCGGATCTCC

TATTGATTACGGTGTGATCGTGGATACTAAAGCTTATAGCGGAGGTTATAATCTGCCAATTGGCCA

AGCAGATGAAATGGAGCGATATGTCGAAGAAAATCAAACACGAAACAAACATCTCAACCCTAATG

AATGGTGGAAAGTCTATCCATCTTCTGTAACGGAATTTAAGTTTTTATTTGTGAGTGGTCACTTTAA

AGGAAACTACAAAGCTCAGCTTACACGATTAAATCATATCACTAATTGTAATGGAGCTGTTCTTAG

TGTAGAAGAGCTTTTAATTGGTGGAGAAATGATTAAAGCCGGCACATTAACCTTAGAGGAAGTGA

GACGGAAATTTAATAACGGCGAGATAAACTTTTAA

VF2468 (-) protein sequence (SEQ ID NO: 126):
MDYKDHDGDYKDHDIDYKDDDDKMAPKKKRKVGIHGVPSRPGERPFQCRICMRNFSTGQILDRHTRT

HTGEKPFQCRICMRNFSVAHSLKRHLRTHTGEKPFQCRICMRNFSDPSNLRRHLKTHLRGSQLVKSELE

EKKSELRHKLKYVPHEYIELIEIARNSTQDRILEMKVMEFFMKVYGYRGKHLGGSRKPDGAIYTVGSPI

DYGVIVDTKAYSGGYNLPIGQADEMERYVEENQTRNKHLNPNEWWKVYPSSVTEFKFLFVSGHFKGN

YKAQLTRLNHITNCNGAVLSVEELLIGGEMIKAGTLTLEEVRRKFNNGEINF
```

Library Construction. Libraries of target sites were incorporated into double-stranded DNA by PCR with Taq DNA Polymerase (NEB) on a pUC19 starting template with primers "N5-PvuI" and "CCR5-224-N4," "CCR5-224-N5," "CCR5-224-N6," "CCR5-224-N7," "VF2468-N4," "VF2468-N5," "VF2468-N6," or "VF2468-N7," yielding an approximately 545-bp product with a PvuI restriction site adjacent to the library sequence, and purified with the Qiagen PCR Purification Kit.

Library-encoding oligonucleotides were of the form 5' backbone-PvuI site-NNNNNN-partially randomized half-site-$N_{4-7}$-partially randomized half site-N-backbone 3'. The purified oligonucleotide mixture (approximately 10 μg) was blunted and phosphorylated with a mixture of 50 units of T4 Polynucleotide Kinase and 15 units of T4 DNA polymerase (NEBNext End Repair Enzyme Mix, NEB) in 1×NEBNext End Repair Reaction Buffer (50 mM Tris-HCl, 10 mM $MgCl_2$, 10 mM dithiothreitol, 1 mM ATP, 0.4 mM dATP, 0.4 mM dCTP, 0.4 mM dGTP, 0.4 mM dTTP, pH 7.5) for 1.5 hours at room temperature. The blunt-ended and phosphorylated DNA was purified with the Qiagen PCR Purification Kit according to the manufacturer's protocol, diluted to 10 ng/μL in NEB T4 DNA Ligase Buffer (50 mM Tris-HCl, 10 mM $MgCl_2$, 10 mM dithiothreitol, 1 mM ATP, pH 7.5) and circularized by ligation with 200 units of T4 DNA ligase (NEB) for 15.5 hours at room temperature. Circular monomers were gel purified on 1% TAE-Agarose gels. 70 ng of circular monomer was used as a substrate for rolling-circle amplification at 30° C. for 20 hours in a 100 μL reaction using the Illustra TempliPhi 100 Amplification Kit (GE Healthcare). Reactions were stopped by incubation at 65° C. for 10 minutes. Target site libraries were quantified with the Quant-iT PicoGreen dsDNA Reagent (Invitrogen). Libraries with $N_4$, $N_5$, $N_6$, and $N_7$ spacer sequences between partially randomized half-sites were pooled in equimolar concentrations for both CCR5-224 and VF2468.

Zinc Finger Nuclease Expression and Characterization. 3×FLAG-tagged zinc finger proteins for CCR5-224 and VF2468 were expressed as fusions to FokI obligate heterodimers[30] in mammalian expression vectors[4] derived from pMLM290 and pMLM292. DNA and protein sequences are provided elsewhere herein. Complete vector sequences are available upon request. 2 μg of ZFN-encoding vector was transcribed and translated in vitro using the TNT Quick Coupled rabbit reticulocyte system (Promega). Zinc chloride (Sigma-Aldrich) was added at 500 μM and the transcription/translation reaction was performed for 2 hours at 30° C. Glycerol was added to a 50% final concentration. Western blots were used to visualize protein using the anti-FLAG M2 monoclonal antibody (Sigma-Aldrich). ZFN concentrations were determined by Western blot and comparison with a standard curve of N-terminal FLAG-tagged bacterial alkaline phosphatase (Sigma-Aldrich).

Test substrates for CCR5-224 and VF2468 were constructed by cloning into the HindIII/XbaI sites of pUC19. PCR with primers "test fwd" and "test rev" and Taq DNA polymerase yielded a linear 1 kb DNA that could be cleaved by the appropriate ZFN into two fragments of sizes ~300 bp and ~700 bp. Activity profiles for the zinc finger nucleases were obtained by modifying the in vitro cleavage protocols used by Miller et al.[30] and Cradick et al.[31]. 1 μg of linear 1 kb DNA was digested with varying amounts of ZFN in 1×NEBuffer 4 (50 mM potassium acetate, 20 mM Tris-acetate, 10 mM magnesium acetate, 1 mM dithiothreitol, pH 7.9) for 4 hours at 37° C. 100 μg of RNase A (Qiagen) was added to the reaction for 10 minutes at room temperature to remove RNA from the in vitro transcription/translation mixture that could interfere with purification and gel analysis. Reactions were purified with the Qiagen PCR Purification Kit and analyzed on 1% TAE-agarose gels.

In Vitro Selection. ZFNs of varying concentrations, an amount of TNT reaction mixture without any protein-encoding DNA template equivalent to the greatest amount of ZFN used ("lysate"), or 50 units PvuI (NEB) were incubated with 1 μg of rolling-circle amplified library for 4 hours at 37° C. in 1×NEBuffer 4 (50 mM potassium acetate, 20 mM Tris-acetate, 10 mM magnesium acetate, 1 mM dithiothreitol, pH 7.9). 100 μg of RNase A (Qiagen) was added to the reaction for 10 minutes at room temperature to remove RNA from the in vitro transcription/translation mixture that could interfere with purification and gel analysis. Reactions were purified with the Qiagen PCR Purification Kit. 1/10 of the reaction mixture was visualized by gel electrophoresis on a 1% TAE-agarose gel and staining with SYBR Gold Nucleic Acid Gel Stain (Invitrogen).

The purified DNA was blunted with 5 units DNA Polymerase I, Large (Klenow) Fragment (NEB) in 1×NEBuffer 2 (50 mM NaCl, 10 mM Tris-HCl, 10 mM MgCl$_2$, 1 mM dithiothreitol, pH 7.9) with 500 μM dNTP mix (Bio-Rad) for 30 minutes at room temperature. The reaction mixture was purified with the Qiagen PCR Purification Kit and incubated with 5 units of Klenow Fragment (3' exo⁻) (NEB) for 30 minutes at 37° C. in 1×NEBuffer 2 (50 mM NaCl, 10 mM Tris-HCl, 10 mM MgCl$_2$, 1 mM dithiothreitol, pH 7.9) with 240 μM dATP (Promega) in a 50 μL final volume. 10 mM Tris-HCl, pH 8.5 was added to a volume of 90 μL and the reaction was incubated for 20 minutes at 75° C. to inactivate the enzyme before cooling to 12° C. 300 fmol of "adapter1/2", barcoded according to enzyme concentration, or 6 pmol of "adapter1/2" for the PvuI digest, were added to the reaction mixture, along with 10 ul 10×NEB T4 DNA Ligase Reaction Buffer (500 mM Tris-HCl, 100 mM MgCl$_2$, 100 mM dithiothreitol, 10 mM ATP). Adapters were ligated onto the blunt DNA ends with 400 units of T4 DNA ligase at room temperature for 17.5 hours and ligated DNA was purified away from unligated adapters with Illustra Microspin S-400 HR sephacryl columns (GE Healthcare). DNA with ligated adapters were amplified by PCR with 2 units of Phusion Hot Start II DNA Polymerase (NEB) and 10 pmol each of primers "PE1" and "PE2" in 1× Phusion GC Buffer supplemented with 3% DMSO and 1.7 mM MgCl$_2$. PCR conditions were 98° C. for 3 min, followed by cycles of 98° C. for 15 s, 60° C. for 15 s, and 72° C. for 15 s, and a final 5 min extension at 72° C. The PCR was run for enough cycles (typically 20-30) to see a visible product on gel. The reactions were pooled in equimolar amounts and purified with the Qiagen PCR Purification Kit. The purified DNA was gel purified on a 1% TAE-agarose gel, and submitted to the Harvard Medical School Biopolymers Facility for Illumina 36-base paired-end sequencing.

Data Analysis. Illumina sequencing reads were analyzed using programs written in C++. Algorithms are described elsewhere herein (e.g., Protocols 1-9), and the source code is available on request. Sequences containing the same barcode on both paired sequences and no positions with a quality score of 'B' were binned by barcode. Half-site sequence, overhang and spacer sequences, and adjacent randomized positions were determined by positional relationship to constant sequences and searching for sequences similar to the designed CCR5-224 and VF2468 recognition sequences. These sequences were subjected to a computational selection step for complementary, filled-in overhang ends of at least 4 base pairs, corresponding to rolling-circle concatemers that had been cleaved at two adjacent and identical sites. Specificity scores were calculated with the formulae: positive specificity score=(frequency of base pair at position[post-selection]−frequency of base pair at position[pre-selection])/(1−frequency of base pair at position[pre-selection]) and negative specificity score=(frequency of base pair at position[post-selection]−frequency of base pair at position[pre-selection])/(frequency of base pair at position[pre-selection]).

Positive specificity scores reflect base pairs that appear with greater frequency in the post-selection library than in the starting library at a given position; negative specificity scores reflect base pairs that are less frequent in the post-selection library than in the starting library at a given position. A score of +1 indicates an absolute preference, a score of −1 indicates an absolute intolerance, and a score of 0 indicates no preference.

Assay of Genome Modification at Cleavage Sites in Human Cells. CCR5-224 ZFNs were cloned into a CMV-driven mammalian expression vector in which both ZFN monomers were translated from the same mRNA transcript in stoichiometric quantities using a self-cleaving T2A peptide sequence similar to a previously described vector[32]. This vector also expresses enhanced green fluorescent protein (eGFP) from a PGK promoter downstream of the ZFN expression cassette. An empty vector expressing only eGFP was used as a negative control.

To deliver ZFN expression plasmids into cells, 15 μg of either active CCR5-224 ZFN DNA or empty vector DNA were used to Nucleofect 2×10⁶ K562 cells in duplicate reactions following the manufacturer's instructions for Cell Line Nucleofector Kit V (Lonza). GFP-positive cells were isolated by FACS 24 hours post-transfection, expanded, and harvested five days post-transfection with the QIAamp DNA Blood Mini Kit (Qiagen).

PCR for 37 potential CCR5-224 substrates and 97 potential VF2468 substrates was performed with Phusion DNA Polymerase (NEB) and primers "[ZFN] [#] fwd" and "[ZFN] [#] rev" (Table 9) in 1× Phusion HF Buffer supplemented with 3% DMSO. Primers were designed using Primer3[33]. The amplified DNA was purified with the Qiagen PCR Purification Kit, eluted with 10 mM Tris-HCl, pH 8.5, and quantified by 1K Chip on a LabChip GX instrument (Caliper Life Sciences) and combined into separate equimolar pools for the catalytically active and empty vector control samples. PCR products were not obtained for 3 CCR5 sites and 7 VF2468 sites, which excluded these samples from further analysis. Multiplexed Illumina library preparation was performed according to the manufacturer's specifications, except that AMPure XP beads (Agencourt) were used for purification following adapter ligation and PCR enrichment steps. Illumina indices 11 ("GGCTAC") and 12 ("CTTGTA") were used for ZFN-treated libraries while indices 4 ("TGACCA") and 6 ("GCCAAT") were used for the empty vector controls. Library concentrations were quantified by KAPA Library Quantification Kit for Illumina Genome Analyzer Platform (Kapa Biosystems). Equal amounts of the barcoded libraries derived from active- and empty vector-treated cells were diluted to 10 nM and subjected to single read sequencing on an Illumina HiSeq 2000 at the Harvard University FAS Center for Systems Biology Core facility. Sequences were analyzed using Protocol 9 for active ZFN samples and empty vector controls.

Statistical Analysis. In FIG. 8, P-values were calculated for a one-sided test of the difference in the means of the number of target site mutations in all possible pairwise comparisons among pre-selection, 0.5 nM post-selection, 1 nM post-selection, 2 nM post-selection, and 4 nM post-selection libraries for CCR5-224 or VF2468. The t-statistic was calculated as $t=(x\_bar_1-x\_bar_2)/sqrt(1 \times p\_hat_1 \times (1-p\_hat_1)/n_1 + 1 \times p\_hat_2 \times (1-p\_hat_2)/n_2)$, where $x\_bar_1$ and $x\_bar_2$ are the means of the distributions being compared, 1 is the target site length (24 for CCR5-224; 18 for VF2468), $p\_hat_1$ and $p\_hat_2$ are the calculated probabilities of mutation ($x\_bar/1$) for each library, and $n_1$ and $n_2$ are the total number of sequences analyzed for each selection (Table 2). All pre- and post-selection libraries were assumed to be binomially distributed.

In Tables 4 and 7, P-values were calculated for a one-sided test of the difference in the proportions of sequences with insertions or deletions from the active ZFN sample and the empty vector control samples. The t-statistic was calculated as $t=(p\_hat_1-p\_hat_2)/sqrt((p\_hat_1 \times (1-p\_hat_1)/n_1)+(p\_hat_2 \times (1-p\_hat_2)/n_2))$, where $p\_hat_1$ and $n_1$ are the proportion and total number, respectively, of sequences from the active sample and $p\_hat_2$ and $n_2$ are the proportion and total number, respectively, of sequences from the empty vector control sample.

Plots. All heat maps were generated in the R software package with the following command: image([variable], zlim=c(−1,1), col=colorRampPalette(c("red","white", "blue"),space="Lab")(2500)

Protocol 1: Quality Score Filtering and Sequence Binning.
1) search each position of both pairs of sequencing read for quality score, reject if any position has quality score='B'
2) output to separate files all sequence reads where the first sequence in the pair start with barcodes ("AAT", "ATA", "TAA", "CAC","TCG") and count the number of sequences corresponding to each barcode Protocol 2: Filtering by ZFN ("AAT","ATA","TAA", "CAC")
For each binned file,
1) accept only sequence pairs where both sequences in the pair start with the same barcode
2) identify orientation of sequence read by searching for constant regions
   orientation 1 is identified by the constant region "CGATCGTTGG" (SEQ ID NO:127)
   orientation 2 is identified by the constant region "CAGTGAACG" (SEQ ID NO:128)
3) search sequences from position 4 (after the barcode) up to the first position in the constant region for the subsequence that has the fewest mutations compared to the CCR5-224 and VF2468 half site that corresponds to the identified constant region
   search sequences with orientation 1 for "GATGAGGATGAC" (SEQ ID NO:129) (CCR5-224(+)) and "GACGCTGCT" (SEQ ID NO:130) (VF2468(−))
   search sequences with orientation 2 for "AAACTGCAAAAG" (SEQ ID NO:131) (CCR5-224(−)) and "GAGTGAGGA" (SEQ ID NO:132) (VF2468(+))
4) bin sequences as CCR5-224 or VF2468 by testing for the fewest mutations across both half-sites
5) the positions of the half-sites and constant sequences are used to determine the overhang/spacer sequences, the flanking nucleotide sequences, and the tag sequences
   the subsequence between the half-site of orientation 1 and the constant region is the tag sequence
o if there is no tag sequence, the tag sequence is denoted by 'X'
   the overhang sequence is determined by searching for the longest reverse-complementary subsequences between the subsequences of orientation 1 and orientation 2 that start after the barcodes
   the spacer sequence is determined by concatenating the reverse complement of the subsequence in orientation 1 that is between the overhang and the half-site (if any), the overhang, and the subsequence in orientation 2 that is between the overhang and the halfsite
o if there is overlap between the overhang and half-site, only the non-overlapping subsequence present in the overhang is counted as part of the spacer
6) to remove duplicate sequences, sort each sequence pair into a tree
   each level of the tree corresponds to a position in the sequence
   each node at each level corresponds to a particular base (A, C, G, T, or X=not(A, C, G, or T)) and points to the base of the next position (A,C,G,T,X)
   the sequence pairs are encoded in the nodes and a subsequence consisting of the concatenation of the spacer sequence, flanking nucleotide sequence, and tag sequence is sorted in the tree
   at the terminal nodes of the tree, each newly entered sequence is compared to all other sequences in the node to avoid duplication
7) the contents of the tree are recursively outputted into separate files based on barcode and ZFN Protocol 3: Library Filtering ("TCG")
1) accept only sequence pairs where both sequences in the pair start with the same barcode
2) analyze the sequence pair that does not contain the sequence "TCGTTGGGAACCGGAGCTGAATGAAGCCATACCAAACGAC" (SEQ ID NO:133) (the other pair contains the library sequence)
3) search sequences for ZFN half-sites and bin by the ZFN site that has fewer mutations
   search for "GTCATCCTCATC" (SEQ ID NO:134) and "AAACTGCAAAAG" (SEQ ID NO:135) (CCR5-224) and "AGCAGCGTC" (SEQ ID NO:136) and "GAGTGAGGA" (SEQ ID NO:137) (VF2468)
4) identify the spacer, flanking nucleotide, and nucleotide tag sequences based on the locations of the half-sites
5) use the tree algorithm in step 6 under Filtering by ZFN to eliminate duplicate sequences Protocol 4: Sequence Profiles
1) analyze only sequences that contain no 'N' positions and have spacer lengths between 4 and 7
2) tabulate the total number of mutations, the spacer length, the overhang length, the nucleotide frequencies for the (+) and (−) half-sites, the nucleotide frequencies for spacers that are 4-bp, 5-bp, 6-bp, and 7-bp long, and the nucleotide frequencies for the flanking nucleotide and the tag sequence
3) repeat steps 1 and 2 for library sequences
4) calculate specificity scores at each position using positive specificity score=(frequency of base pair at position[post-selection]−frequency of base pair at position[pre-selection])/(1−frequency of base pair at position[pre-selection]) negative specificity score=(frequency of base pair at position[post-selection]−frequency of base pair at position [pre-selection])/(frequency of base pair at position[pre-selection])

Protocol 5: Genomic Matches
1) the human genome sequence was searched with 24 and 25 base windows (CCR5-224) and 18 and 19 base windows (VF2468) for all sites within nine mutations (CCR5-224) or six mutations (VF2468) of the canonical target site with all spacer sequences of five or six bases being accepted
2) each post-selection sequence was compared to the set of genomic sequences within nine and six mutations of CCR5-224 and VF2468, respectively Protocol 6: Enrichment Factors for Sequences with 0, 1, 2, or 3 Mutations
1) for each sequence, divide the frequency of occurrence in the post-selection library by the frequency of occurrence in the pre-selection library Protocol 7: Filtered Sequence Profiles
1) use the algorithm described above in Sequence profiles, except in addition, only analyze sequences with off-target bases at given positions for both pre- and post-selection data Protocol 8: Compensation Difference Map
1) use Filtered sequence profiles algorithm for mutation at every position in both half-sites
2) calculate Δ(specificity score)=filtered specificity score−non-filtered specificity score Protocol 9: NHEJ Search
1) identify the site by searching for exact flanking sequences
2) count the number of inserted or deleted bases by comparing the length of the calculated site to the length of the expected site and by searching for similarity to the unmodified target site (sequences with 5 or fewer mutations compared to the intended site were counted as unmodified)
3) inspect all sites other than CCR5, CCR2, and VEGF-A promoter by hand to identify true insertions or deletions References
1. Kim, Y. G., Cha, J. & Chandrasegaran, S. Hybrid restriction enzymes: zinc finger fusions to Fok I cleavage domain. Proc Natl Acad Sci USA 93, 1156-60 (1996).
2. Vanamee, E. S., Santagata, S. & Aggarwal, A. K. FokI requires two specific DNA sites for cleavage. J Mol Biol 309, 69-78 (2001).
3. Hockemeyer, D. et al. Efficient targeting of expressed and silent genes in human ESCs and iPSCs using zinc-finger nucleases. Nat Biotechnol 27, 851-7 (2009).
4. Maeder, M. L. et al. Rapid "open-source" engineering of customized zinc-finger nucleases for highly efficient gene modification. Mol Cell 31, 294-301 (2008).
5. Zou, J. et al. Gene targeting of a disease-related gene in human induced pluripotent stem and embryonic stem cells. Cell Stem Cell 5, 97-110 (2009).
6. Perez, E. E. et al. Establishment of HIV-1 resistance in CD4+ T cells by genome editing using zinc-finger nucleases. Nat Biotechnol 26, 808-16 (2008).
7. Urnov, F. D. et al. Highly efficient endogenous human gene correction using designed zinc-finger nucleases. Nature 435, 646-51 (2005).
8. Santiago, Y. et al. Targeted gene knockout in mammalian cells by using engineered zinc-finger nucleases. Proc Natl Acad Sci USA 105, 5809-14 (2008).
9. Cui, X. et al. Targeted integration in rat and mouse embryos with zinc-finger nucleases. Nat Biotechnol 29, 64-7 (2011).
10. Cornu, T. I. et al. DNA-binding specificity is a major determinant of the activity and toxicity of zinc-finger nucleases. Mol Ther 16, 352-8 (2008).
11. Segal, D. J., Dreier, B., Beerli, R. R. & Barbas, C. F., 3rd. Toward controlling gene expression at will: selection and design of zinc finger domains recognizing each of the 5'-GNN-3' DNA target sequences. Proc Natl Acad Sci USA 96, 2758-63 (1999).
12. Bulyk, M. L., Huang, X., Choo, Y. & Church, G. M. Exploring the DNA-binding specificities of zinc fingers with DNA microarrays. Proc Natl Acad Sci USA 98, 7158-63 (2001).
13. Meng, X., Thibodeau-Beganny, S., Jiang, T., Joung, J. K. & Wolfe, S. A. Profiling the DNA-binding specificities of engineered Cys2His2 zinc finger domains using a rapid cell-based method. Nucleic Acids Res 35, e81 (2007).
14. Wolfe, S. A., Greisman, H. A., Ramm, E. I. & Pabo, C. O. Analysis of zinc fingers optimized via phage display: evaluating the utility of a recognition code. J Mol Biol 285, 1917-34 (1999).
15. Segal, D. J. et al. Evaluation of a modular strategy for the construction of novel polydactyl zinc finger DNA-binding proteins. Biochemistry 42, 2137-48 (2003).
16. Zykovich, A., Korf, I. & Segal, D. J. Bind-n-Seq: high-throughput analysis of in vitro protein-DNA interactions using massively parallel sequencing. Nucleic Acids Res 37, e151 (2009).
17. Yanover, C. & Bradley, P. Extensive protein and DNA backbone sampling improves structure-based specificity prediction for C2H2 zinc fingers. Nucleic Acids Res (2011).
18. Beumer, K., Bhattacharyya, G., Bibikova, M., Trautman, J. K. & Carroll, D. Efficient gene targeting in Drosophila with zinc-finger nucleases. Genetics 172, 2391-403 (2006).
19. Bibikova, M., Golic, M., Golic, K. G. & Carroll, D. Targeted chromosomal cleavage and mutagenesis in Drosophila using zinc-finger nucleases. Genetics 161, 1169-75 (2002).
20. Gupta, A., Meng, X., Zhu, L. J., Lawson, N. D. & Wolfe, S. A. Zinc finger protein-dependent and -independent contributions to the in vivo off-target activity of zinc finger nucleases. Nucleic Acids Res 39, 381-92 (2011).
21. Chen, J. et al. Molecular cloning and characterization of a novel human BTB domain-containing gene, BTBD10, which is down-regulated in glioma. Gene 340, 61-9 (2004).
22. Wang, X. et al. Glucose metabolism-related protein 1 (GMRP1) regulates pancreatic beta cell proliferation and apoptosis via activation of Akt signalling pathway in rats and mice. Diabetologia 54, 852-63 (2011).
23. Nawa, M., Kanekura, K., Hashimoto, Y., Aiso, S. & Matsuoka, M. A novel Akt/PKB-interacting protein promotes cell adhesion and inhibits familial amyotrophic lateral sclerosis-linked mutant SOD1-induced neuronal death via inhibition of PP2A-mediated dephosphorylation of Akt/PKB. Cell Signal 20, 493-505 (2008).
24. Petek, L. M., Russell, D. W. & Miller, D. G. Frequent endonuclease cleavage at off-target locations in vivo. Mol Ther 18, 983-6 (2010).
25. Hurt, J. A., Thibodeau, S. A., Hirsh, A. S., Pabo, C. O. & Joung, J. K. Highly specific zinc finger proteins obtained by directed domain shuffling and cell-based selection. Proc Natl Acad Sci USA 100, 12271-6 (2003).
26. Ramirez, C. L. et al. Unexpected failure rates for modular assembly of engineered zinc fingers. Nat Methods 5, 374-5 (2008).
27. Shimizu, Y. et al. Adding Fingers to an Engineered Zinc Finger Nuclease Can Reduce Activity. Biochemistry 50, 5033-41 (2011).

28. Bibikova, M. et al. Stimulation of homologous recombination through targeted cleavage by chimeric nucleases. Mol Cell Biol 21, 289-97 (2001).
29. Handel, E. M., Alwin, S. & Cathomen, T. Expanding or restricting the target site repertoire of zinc-finger nucleases: the inter-domain linker as a major determinant of target site selectivity. Mol Ther 17, 104-11 (2009).
30. Miller, J. C. et al. An improved zinc-finger nuclease architecture for highly specific genome editing. Nat Biotechnol 25, 778-85 (2007).
31. Cradick, T. J., Keck, K., Bradshaw, S., Jamieson, A. C. & McCaffrey, A. P. Zinc-finger nucleases as a novel therapeutic strategy for targeting hepatitis B virus DNAs. Mol Ther 18, 947-54 (2010).
32. Doyon, Y. et al. Heritable targeted gene disruption in zebrafish using designed zinc-finger nucleases. Nat Biotechnol 26, 702-8 (2008).
33. Rozen, S. & Skaletsky, H. Primer3 on the WWW for general users and for biologist programmers. Methods Mol Biol 132, 365-86 (2000).

All publications, patents and sequence database entries mentioned herein, including those items listed above, are hereby incorporated by reference in their entirety as if each individual publication or patent was specifically and individually indicated to be incorporated by reference. In case of conflict, the present application, including any definitions herein, will control.

Example 2

TALENs

The site preferences of different TALENs were profiled in analogy to the work done for ZFN profiling described above. The experiments and results are described in FIGS. 19-49. Selection 1 included a comparison between TALENs having a +28 vs. a +63 linker. Selection 2 included a comparison of TALENs of different TAL domain length.

Figure 19:
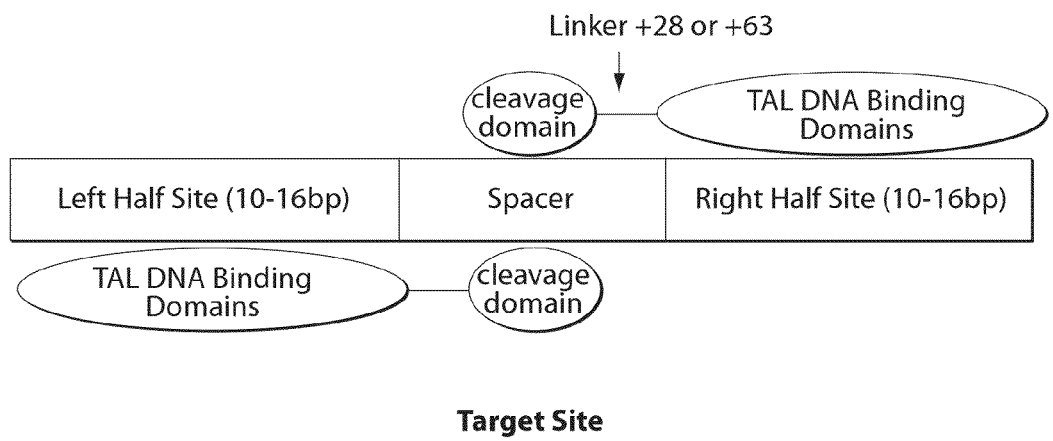
FIG. 19. Profiling The Specificity of TAL Nucleases. Selection 1: +28 vs. +63 aa Linker Between TAL DNA Binding Domain and FokI Cleavage Domain (SEQ ID NOs:42-45).
Figure 20:
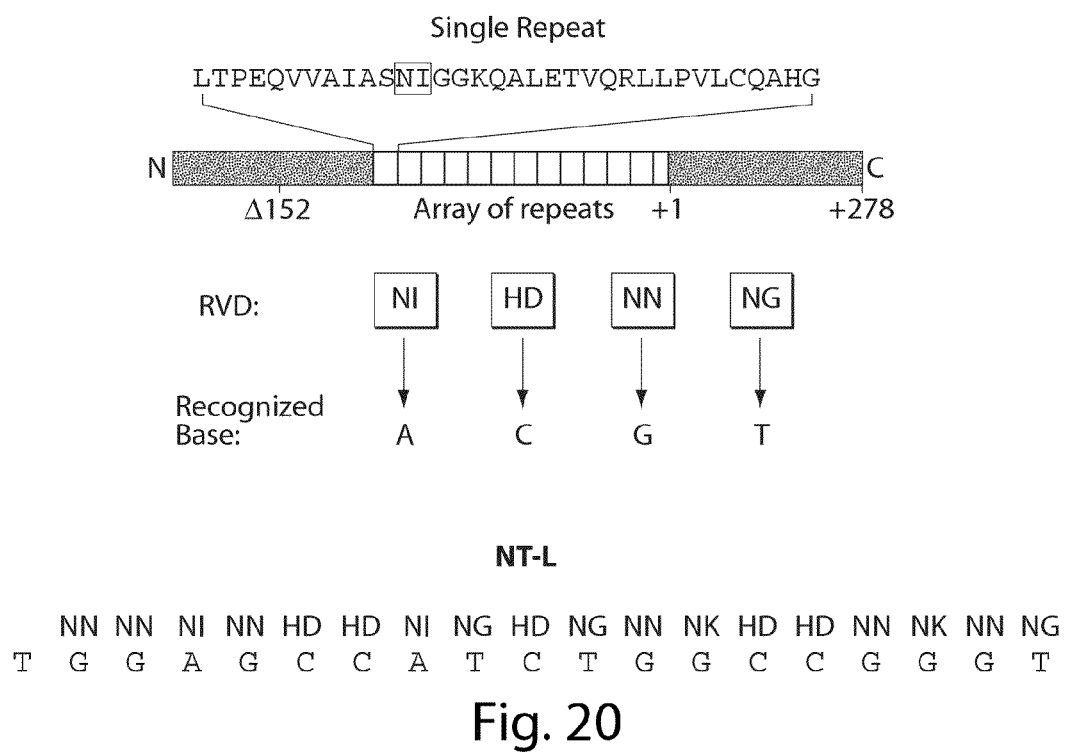
FIG. 20. Structure of TAL DNA binding domain and RVDs (SEQ ID NOs:46 and 47).
Figure 21:
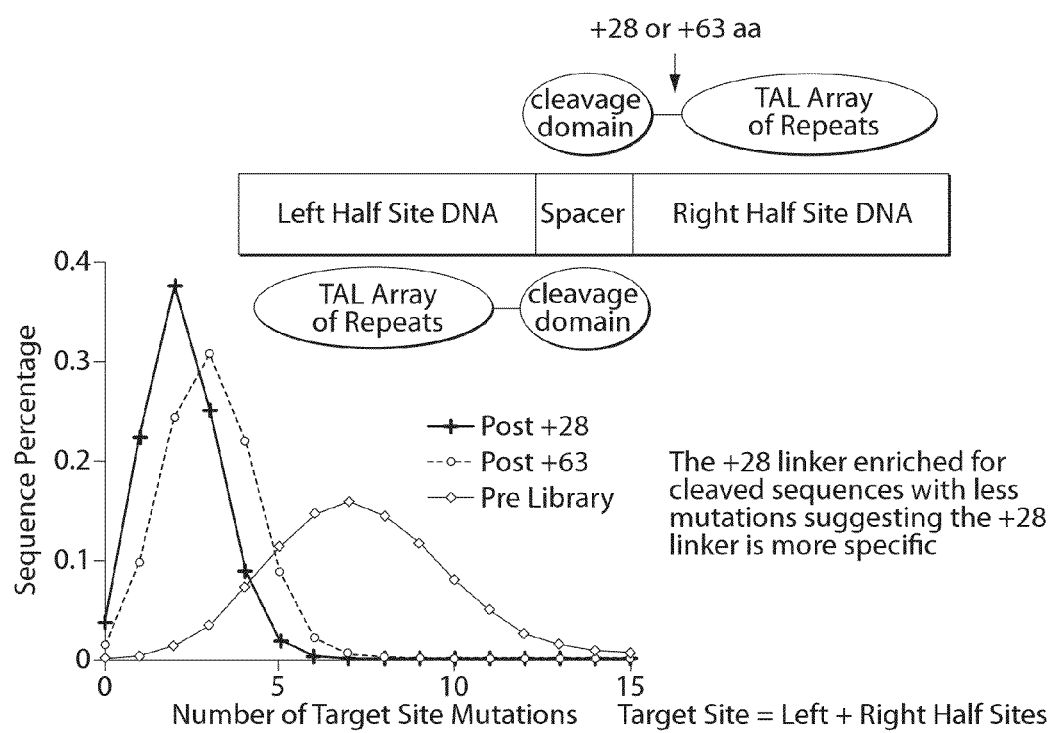
FIG. 21. Mutations in target sites from TALN selection. The +28 linker enriched for cleaved sequences with less mutations suggesting the +28 linker is more specific. There are significantly less mutations in the post-selected sequences compared to the pre-selection library sequences indicating a successful selection FIG. 22. Enrichment of Mutations in Total Target Site Between Left and Right Half Sites of Previous TALN Selection. The relatively regular (log relationship) trend between number of half sites mutations and enrichment is consistent with a single repeat binding a base pair independent of other repeat binding.
Figure 22:
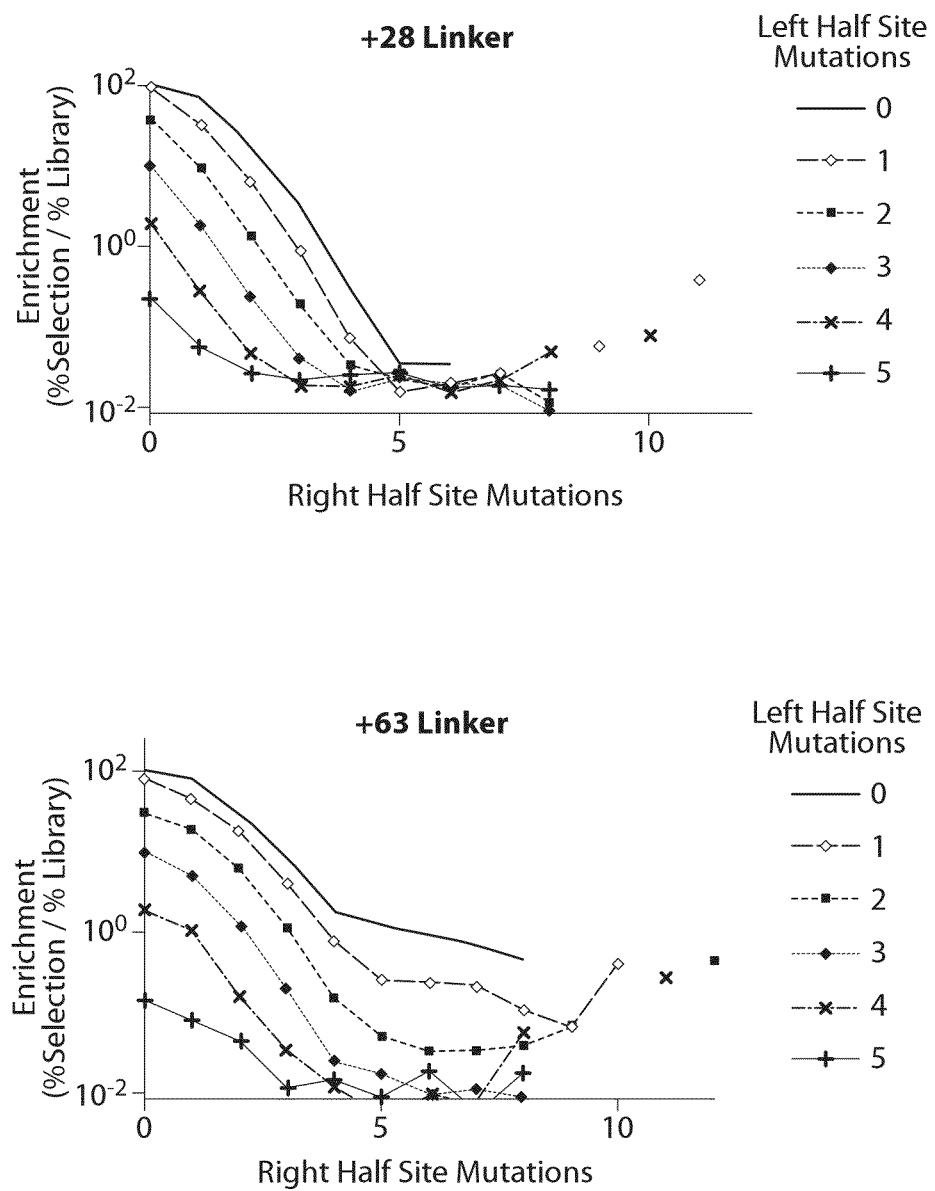
Figure 23:
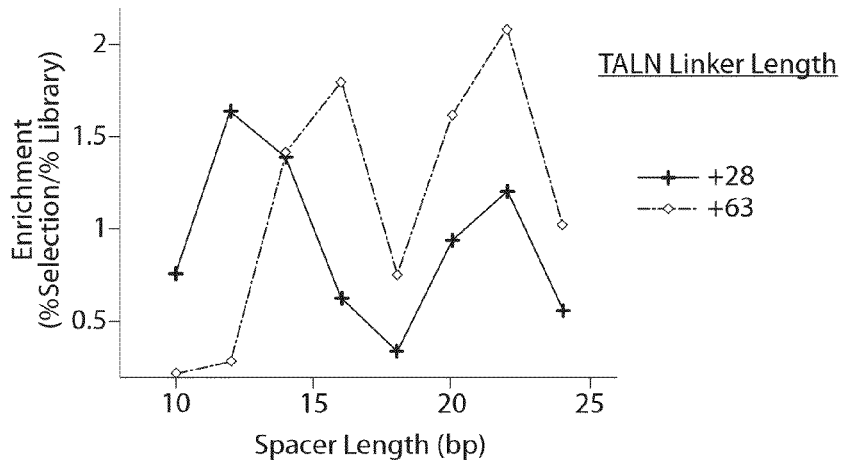
FIG. 23. TALN Cleavage Dependence on DNA Spacer Length. There is a similar preference for cut site spacer lengths in our in vitro selection compared to previous studies. In vitro, TALN cleavage. Dependence on Linker Length & Spacer Length from Mussolino (2011).
Figure 23:
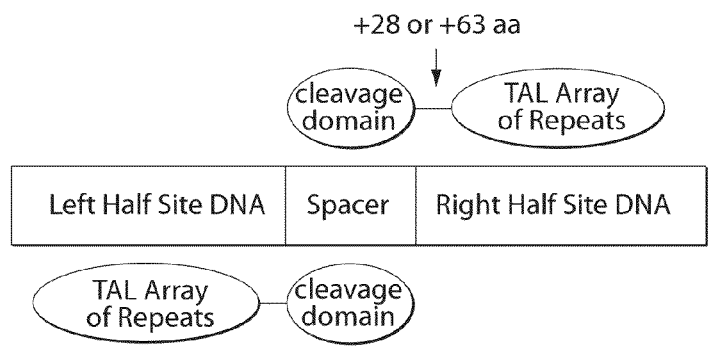
Figure 23:
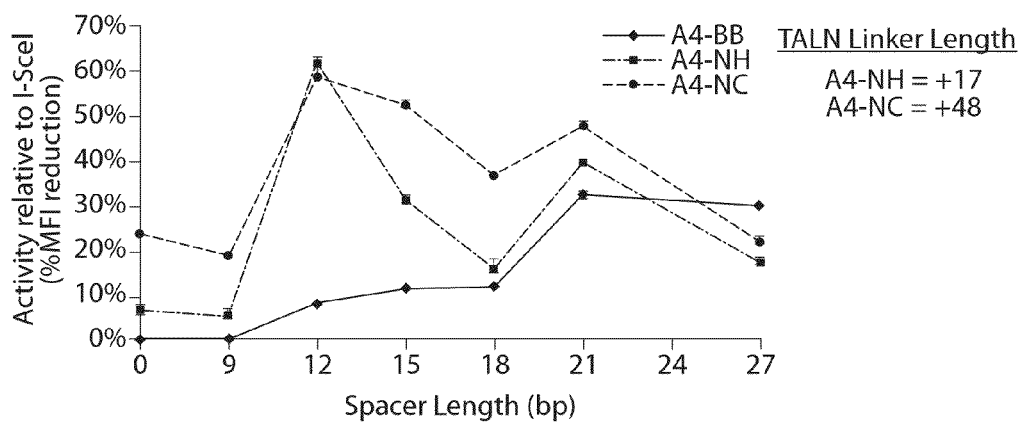
Figure 24:
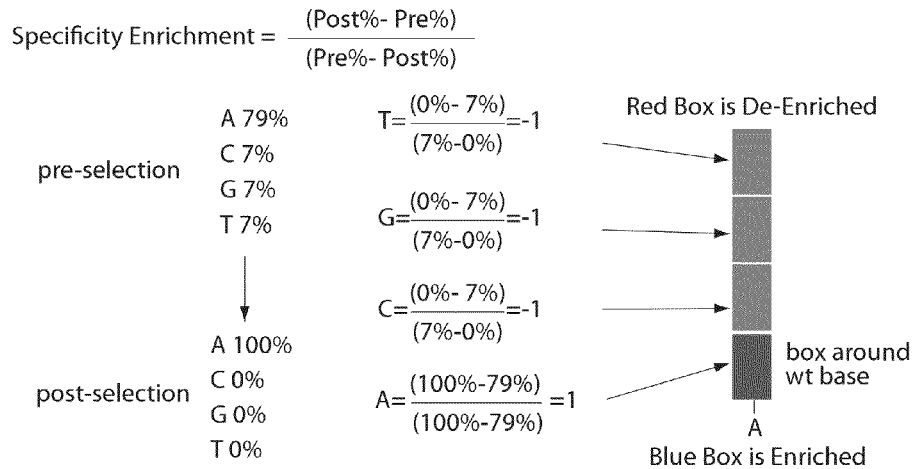
FIG. 24. Specificity score at individual bases.
Figure 25:
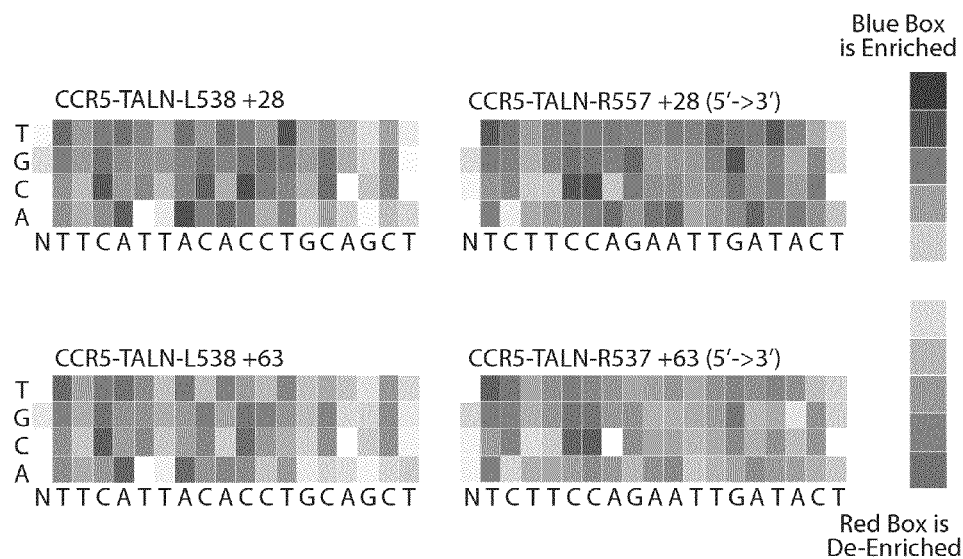
FIG. 25. Specificity score at individual bases. There is variable specificity at each individual position again with +28 linker demonstrating significantly better specificity (SEQ ID NOs:48 and 49).
Figure 26:
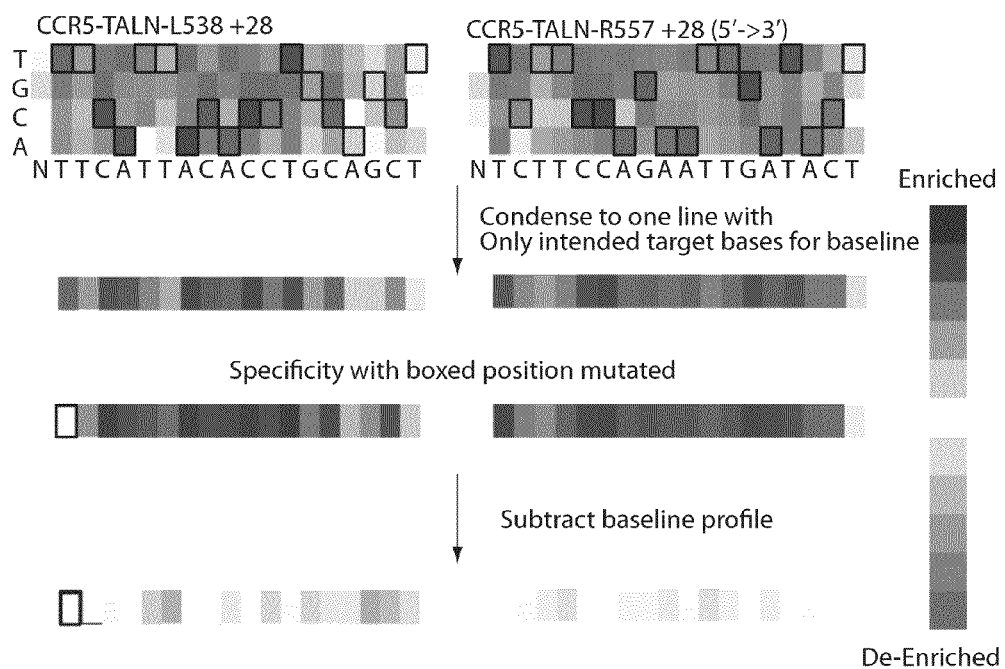
FIG. 26. Compensating Difference in Specificity of TALNs Analysis (SEQ ID NOs:50-51).
Figure 27:
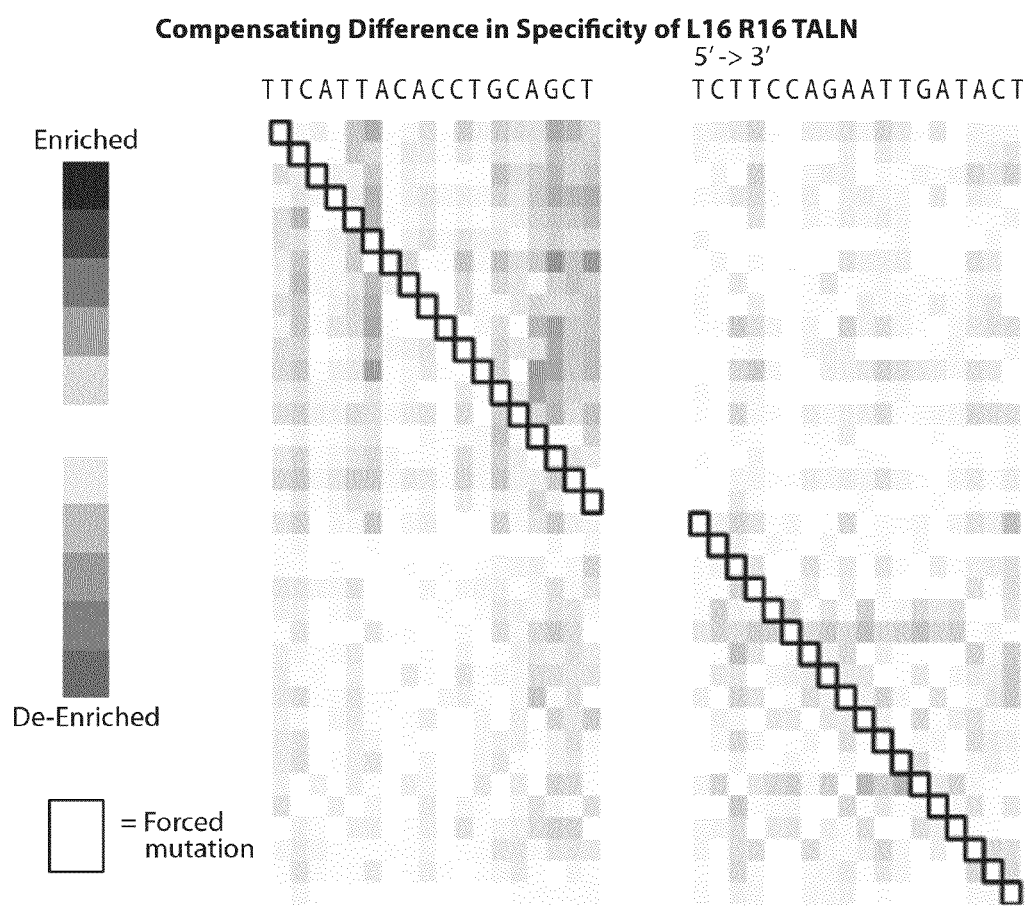
FIG. 27. Compensating Difference in Specificity of L16 R16 TALN. A single mutation in the cleavage site does not alter the distribution of other mutations suggesting that the TAL repeat domains bind independently (SEQ ID NOs:52-53).
Figure 28:
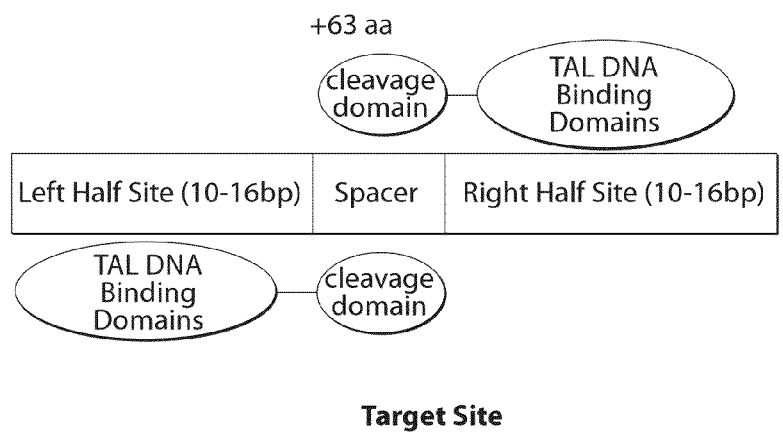
FIG. 28. Profiling the Specificity of TALNs Selection II: Varying TALN Lengths (SEQ ID NOs:54-61).
Figure 29:
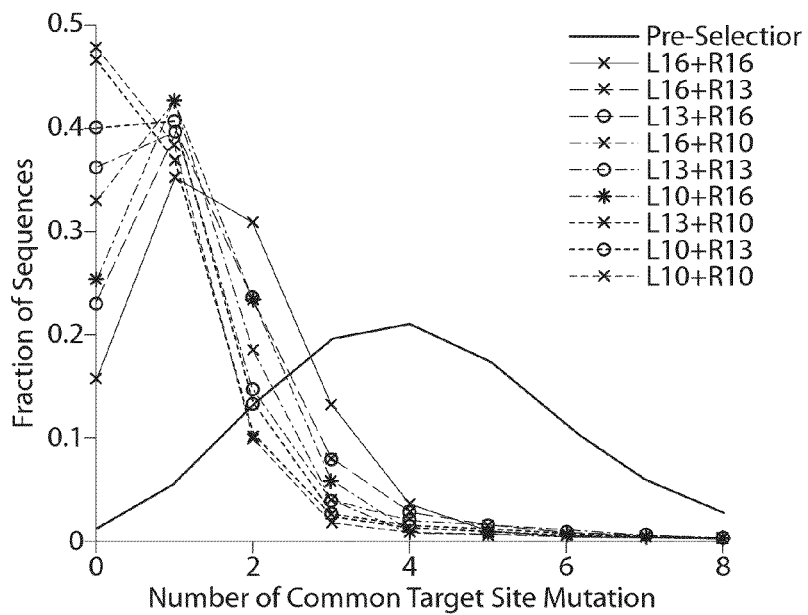
FIG. 29. Enrichment of Mutations in Common Target Site (SEQ ID NOs:62-69).
Figure 30:
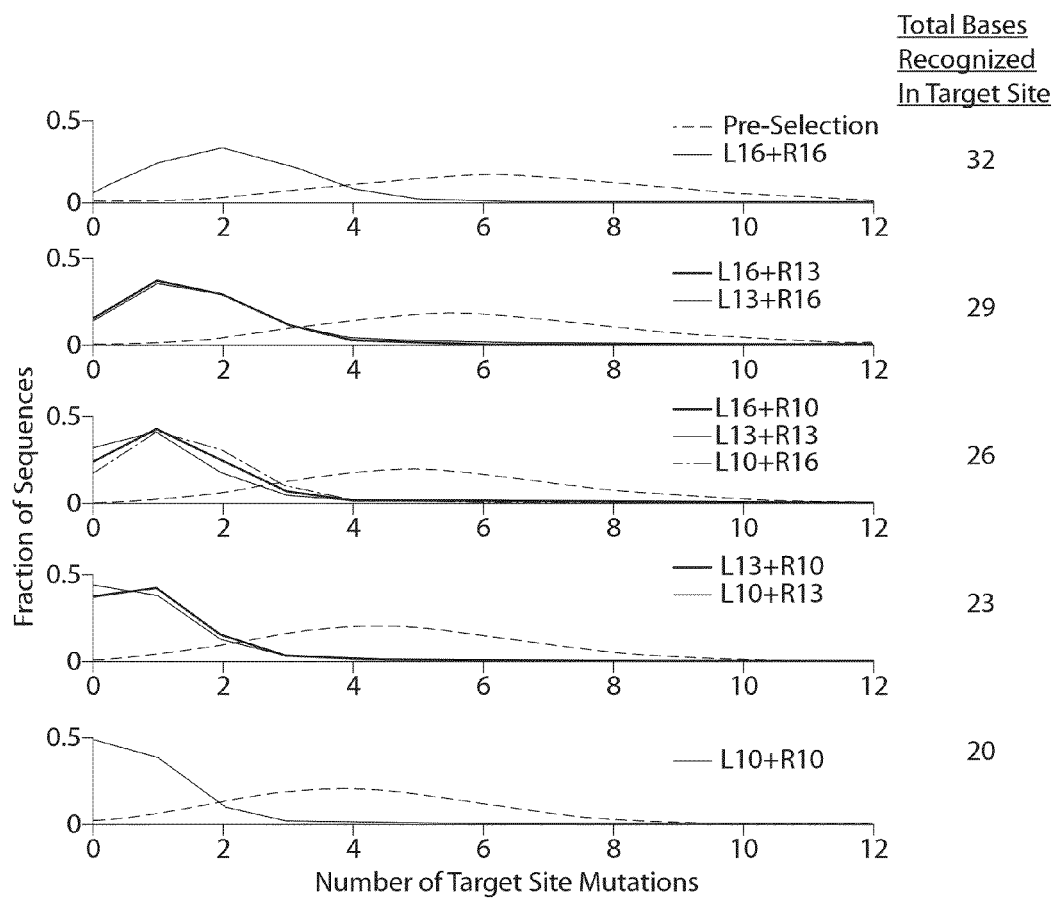
FIG. 30. Distribution of Mutations in Total Targeted Site of TALN Digestion vs. Pre-Selection Library.
Figure 31:
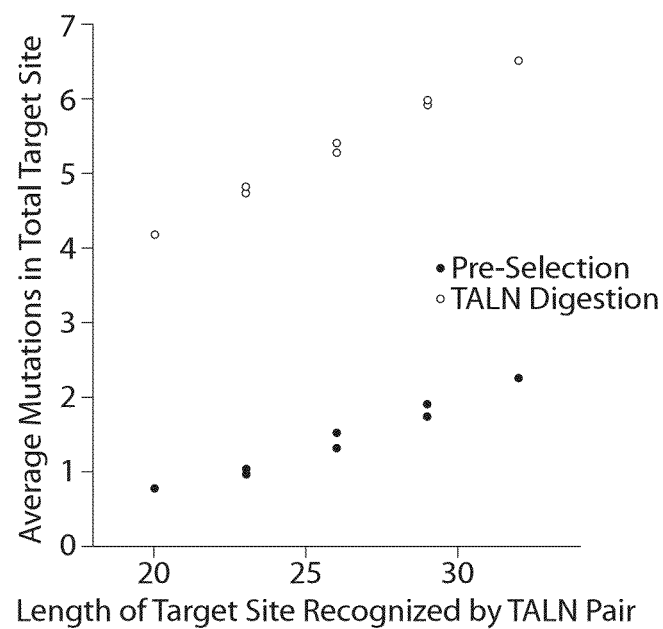
FIG. 31. Distribution of Mutations in Total Targeted Site of TALN Digestion vs. Pre-Selection Library.
Figure 32:
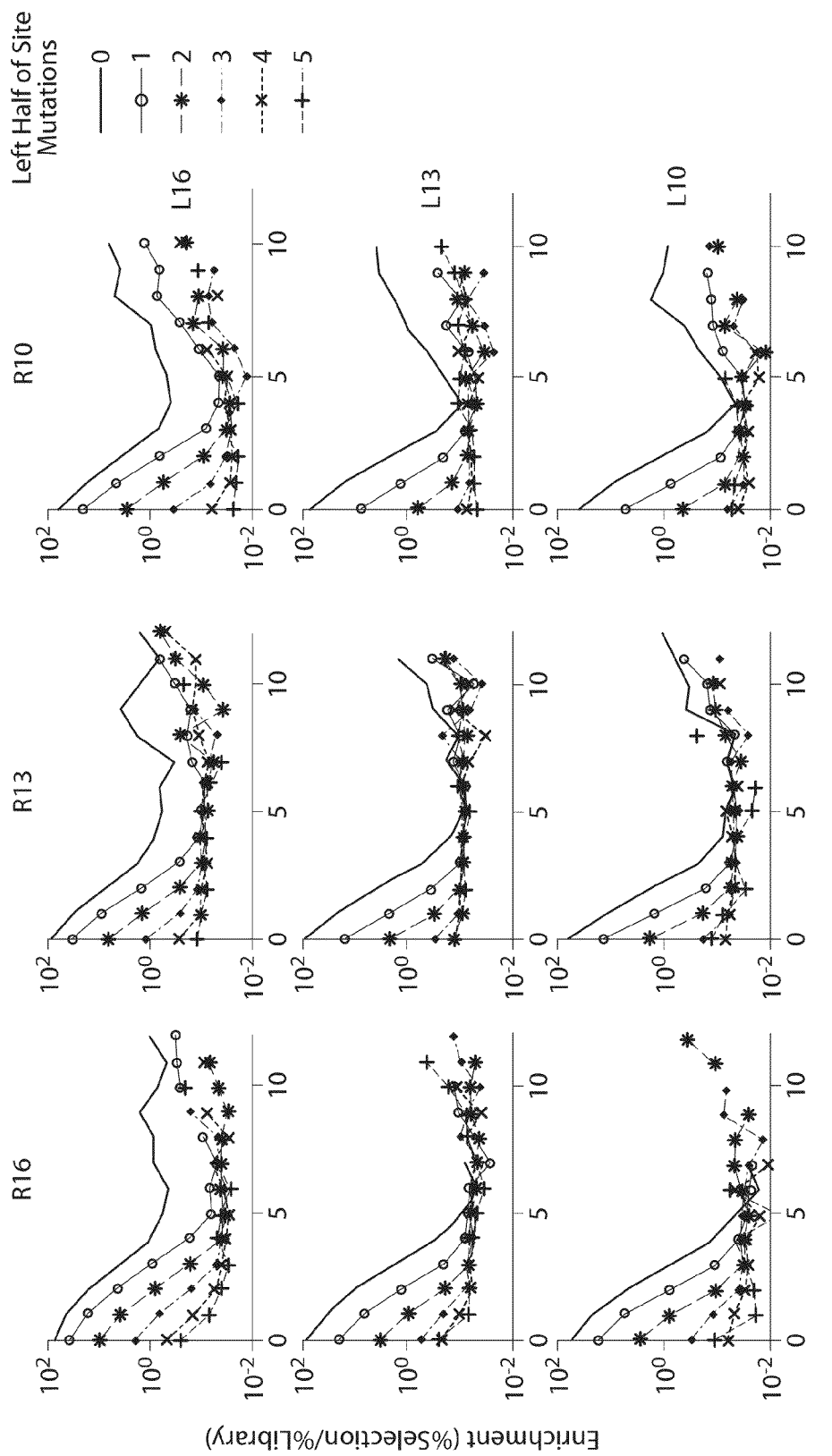
FIG. 32. Enrichment of Mutations in Total Target Site Between Right and Left Half Sites of TALN Pairs.
Figure 33:
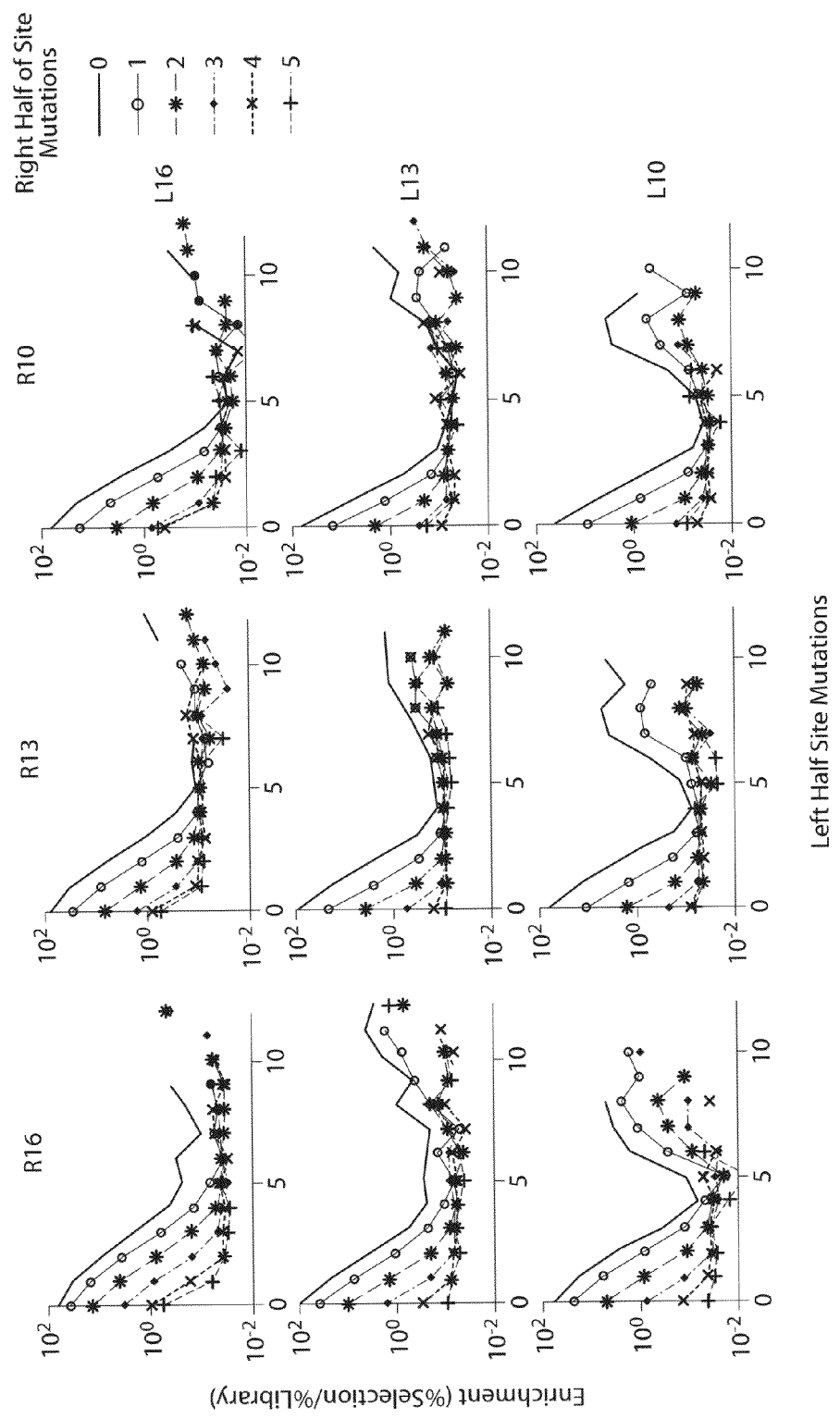
FIG. 33. Enrichment of Mutations in Total Target Site Between Right and Left Half Sites of TALN Pairs.
Figure 34:
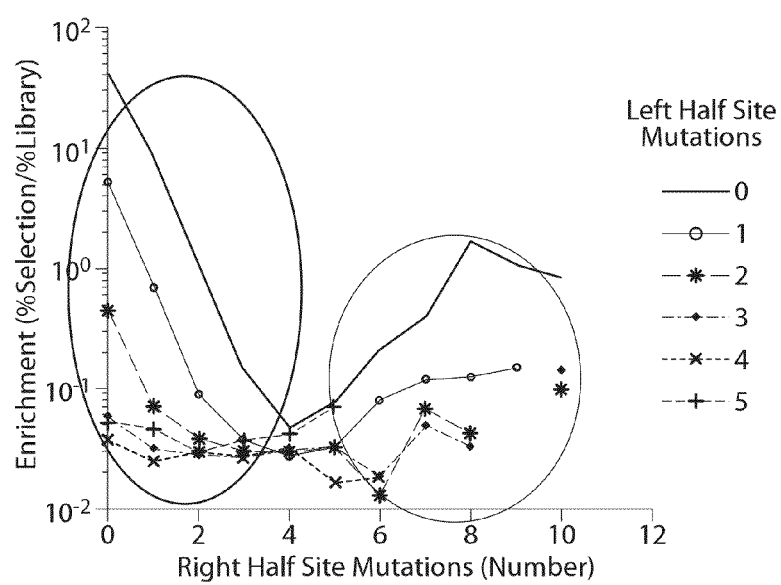
FIG. 34. Enrichment of Mutations in Total Targeted Site of TALN Digestion vs. Pre-Selection Library for L10 R10 TALN Pair.
Figure 35:
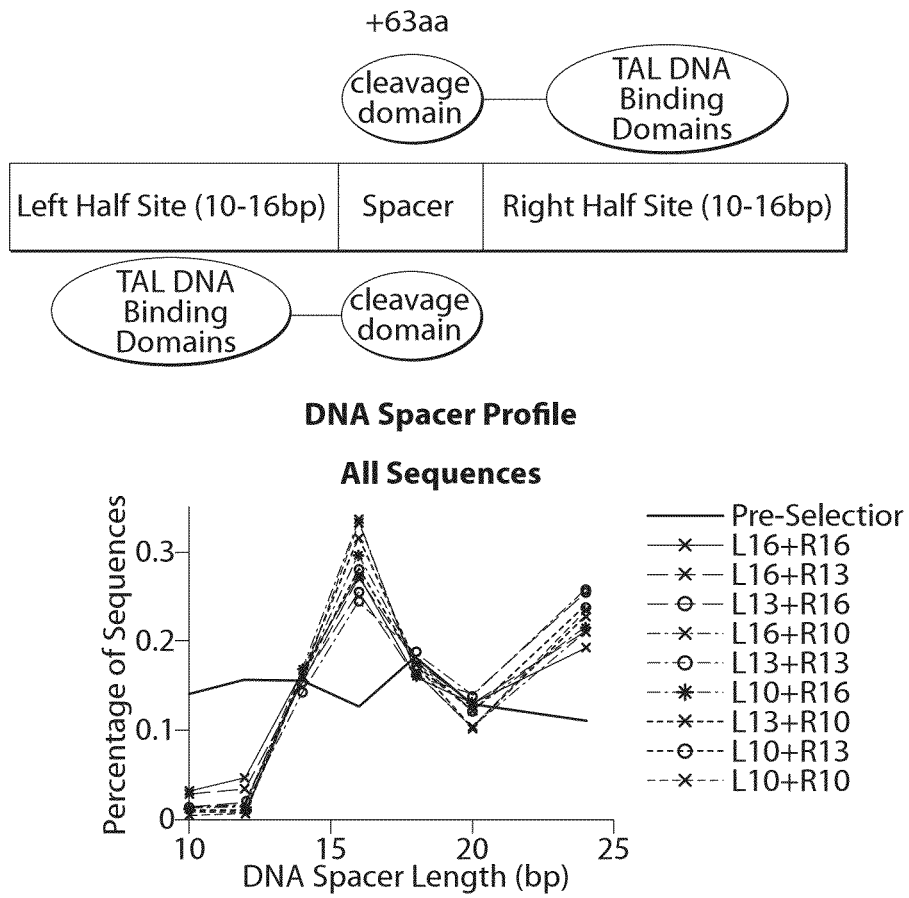
FIG. 35. DNA spacer profile. While the vast majority of sequences have a spacer preference, the highly mutant sequences have no significant spacer preference as might be expected from alternate frames changing the spacer length.
Figure 35:
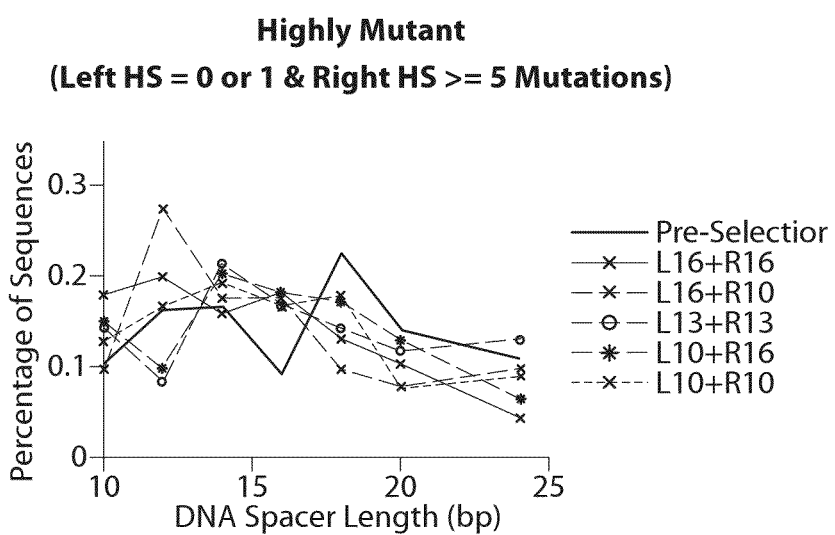
Figure 36:
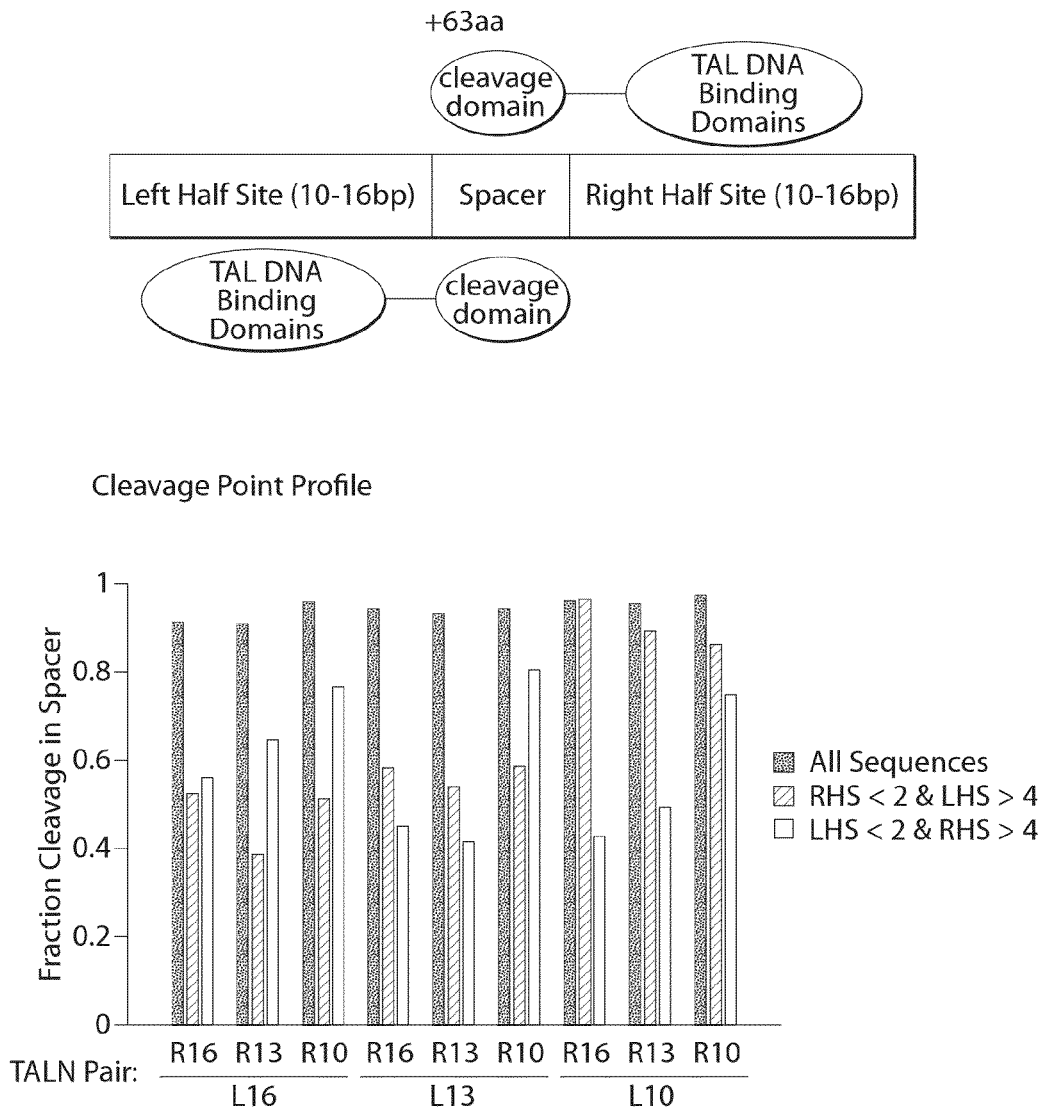
FIG. 36. Cleavage point profile. While the vast majority of sequences are cut in the spacer as expected, the R16 L16 highly mutant sequences are not predominately cut in spacer but the L10 R10 ones are cut in the spacer possibly indicative of a frame-shifted binding site leading to productive spacer cutting.
Figure 37:
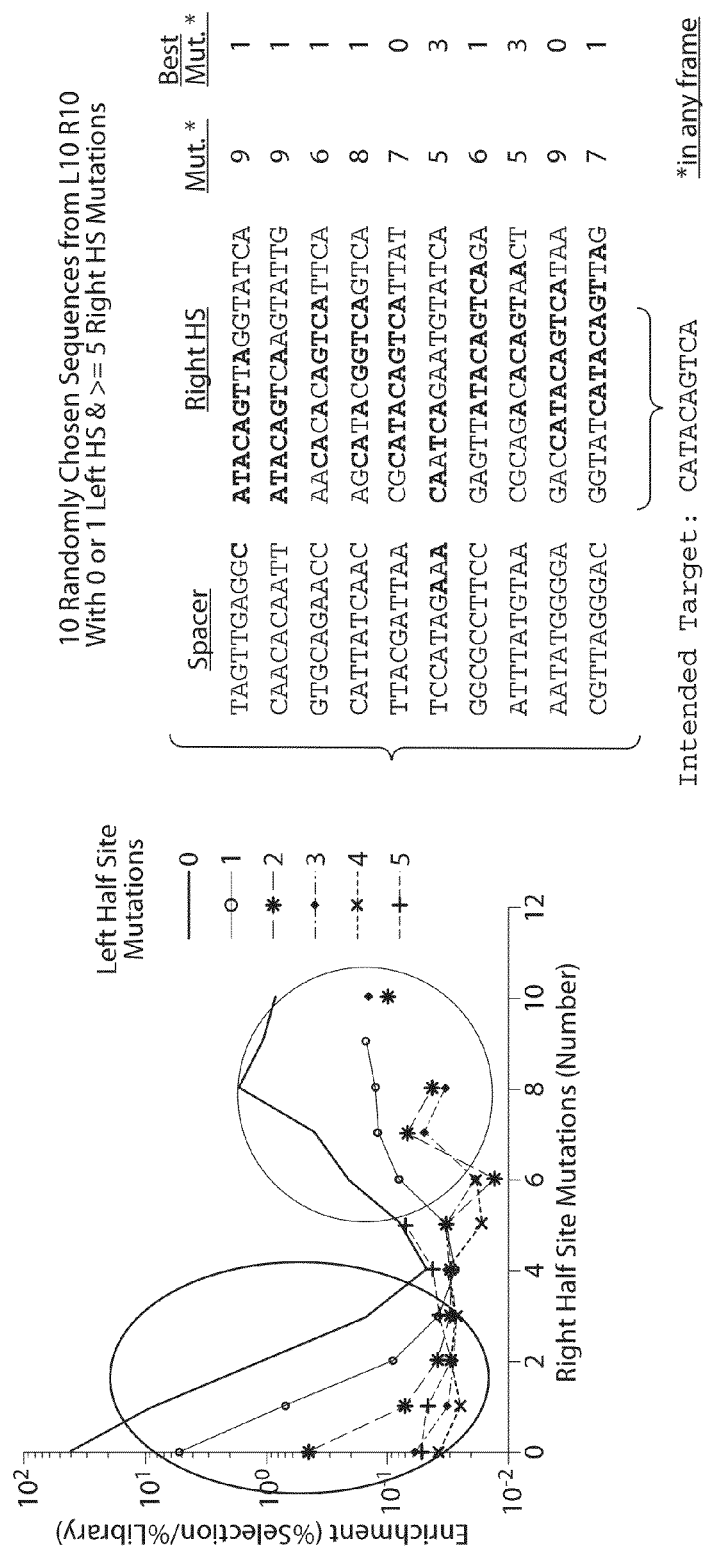
FIG. 37. Highly Mutant Half Sites in L10 R10 TALN Pair. Many potential binding sites in frames outside of the intended frame have sites more similar to the intended target (SEQ ID NOs:70-90).
Figure 38:
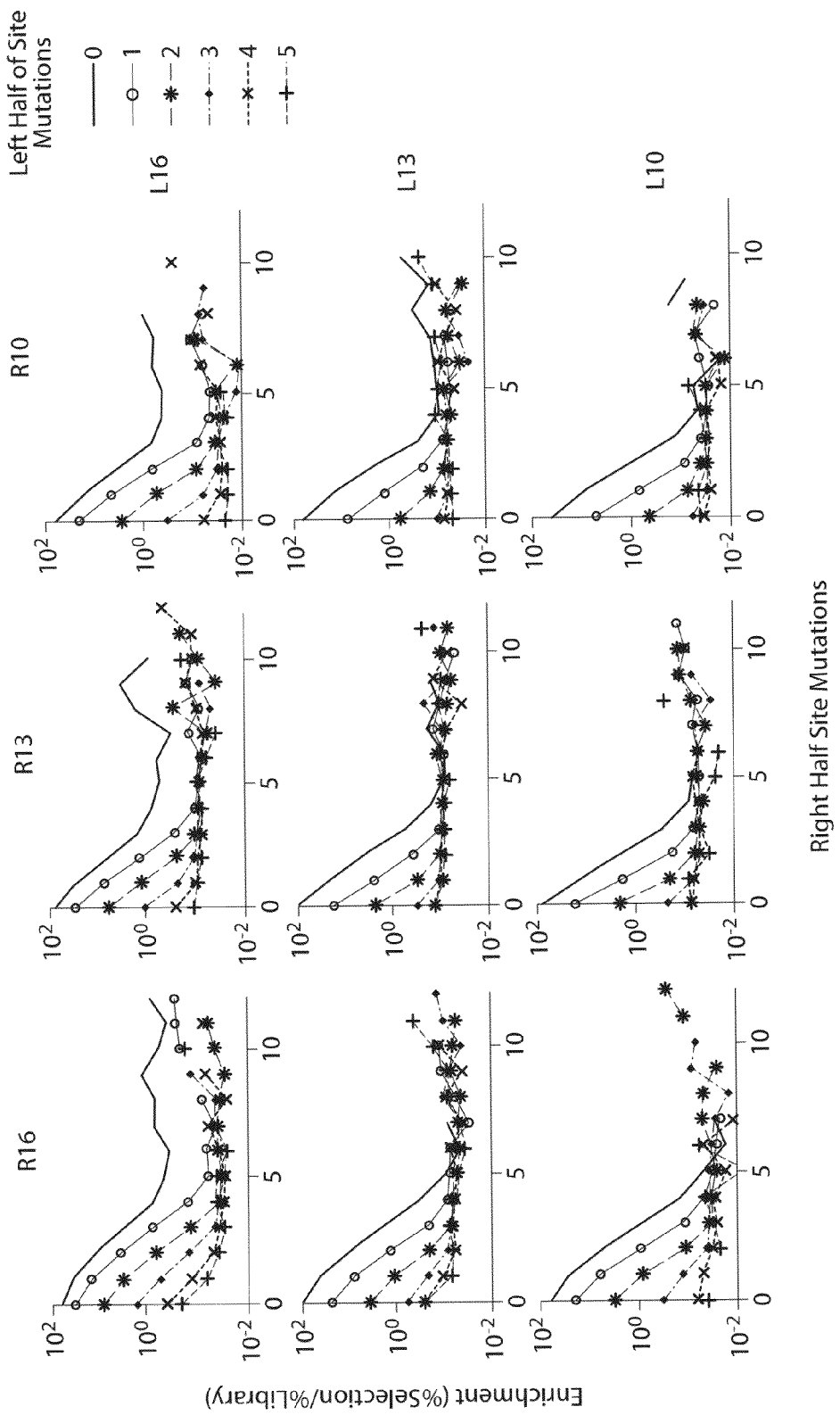
FIG. 38. Enrichment of Mutations in Total Target Site Between Left and Right Half Sites of TALN Pairs Edited for Frame-shifted Binding Sites.
Figure 39:
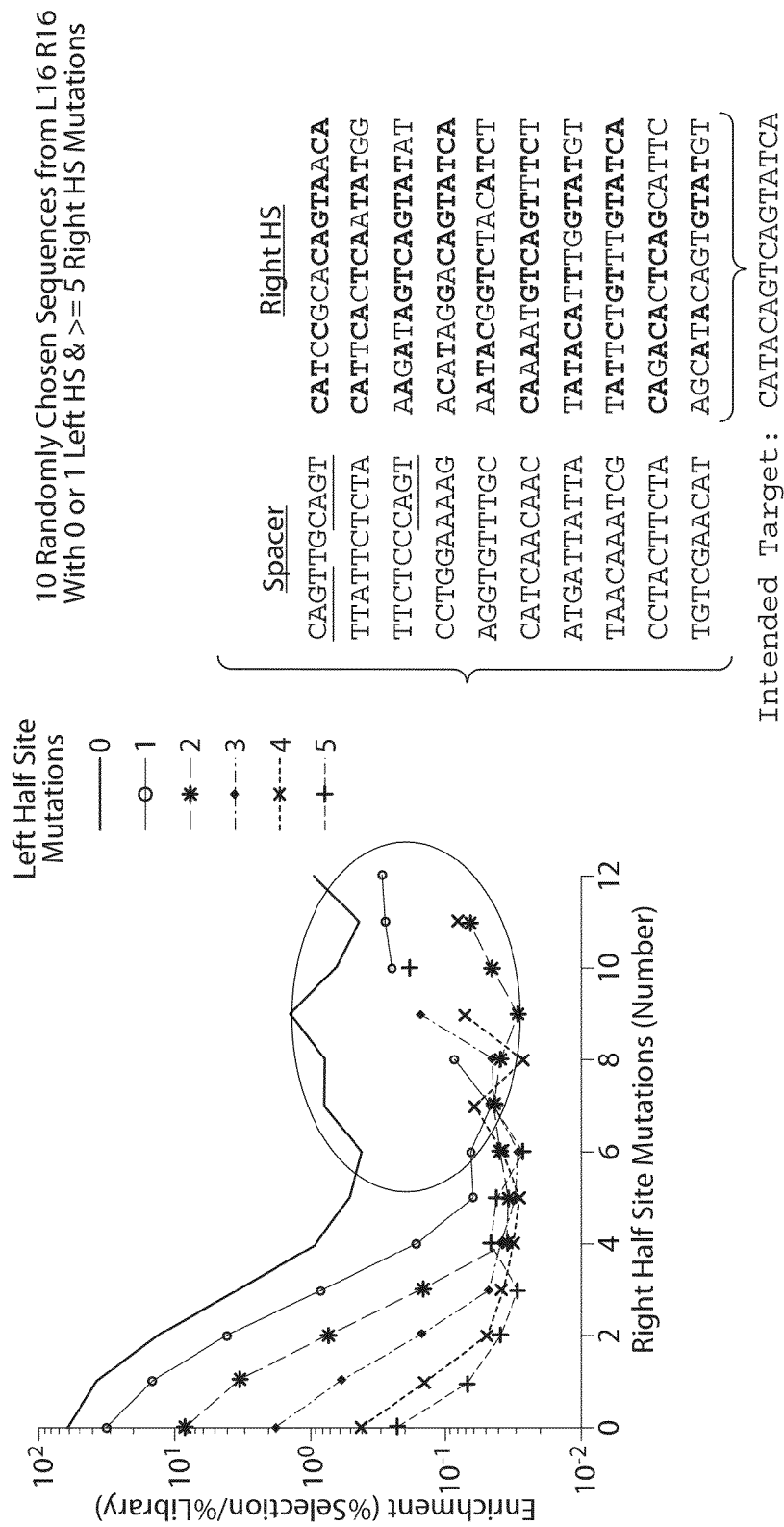
FIG. 39. Highly Mutant Half Sites in L16 R16 TALN Pair (SEQ ID NOs:91-111).
Figure 40:
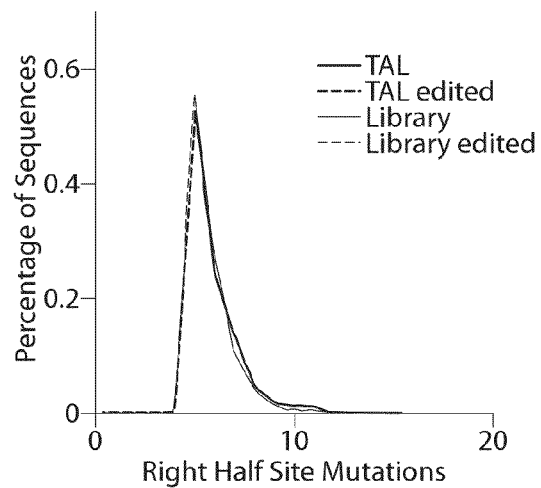
FIG. 40. Highly Mutant Half Sites in L16 R16 TALN Pair. The highly mutant sequences from L16 R16 cannot be explained by a frame-shift (left figure), have no DNA Spacer preference (see slide 11) and seem to be cutting more often outside of the DNA Spacer (right figure) indicating perhaps homodimer cleavage (even with heterodimer) or heterodimer cleavage independent of a TAL domain binding target site DNA (i.e. dimerization through the FokI cleavage domain).
Figure 40:
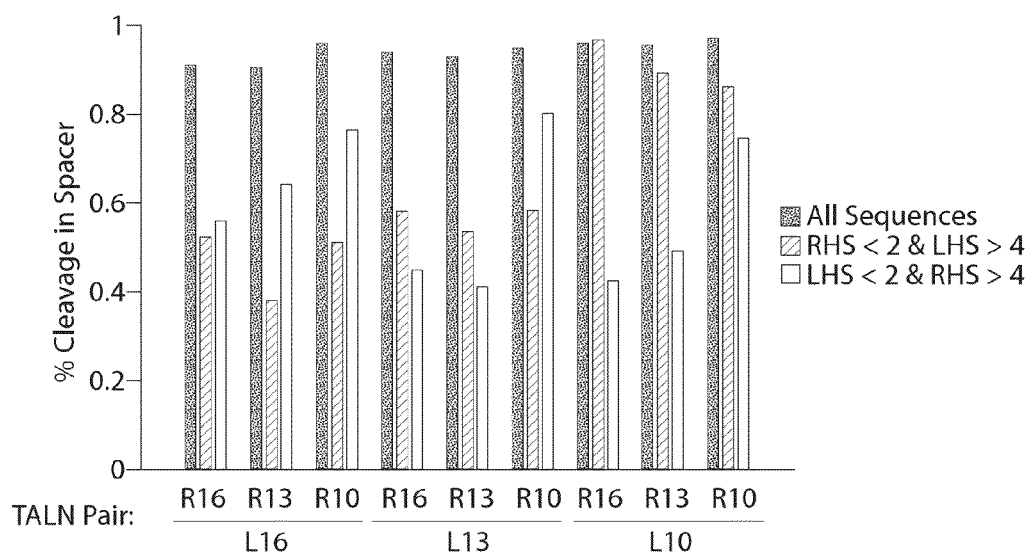
Figure 41:
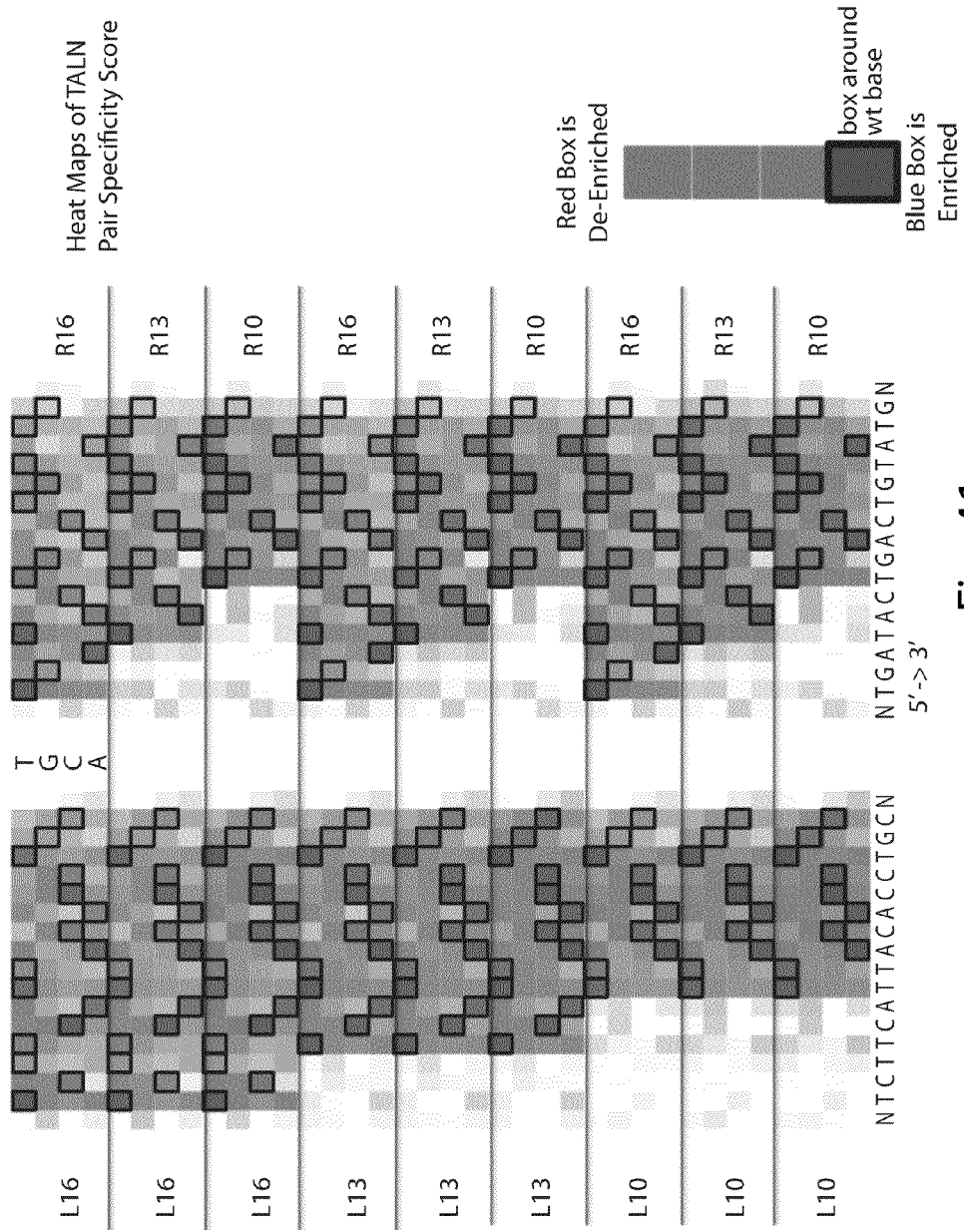
FIG. 41. Heat Maps of TALN Pair Specificity Score (SEQ ID NOs:112 and 113).
Figure 42:
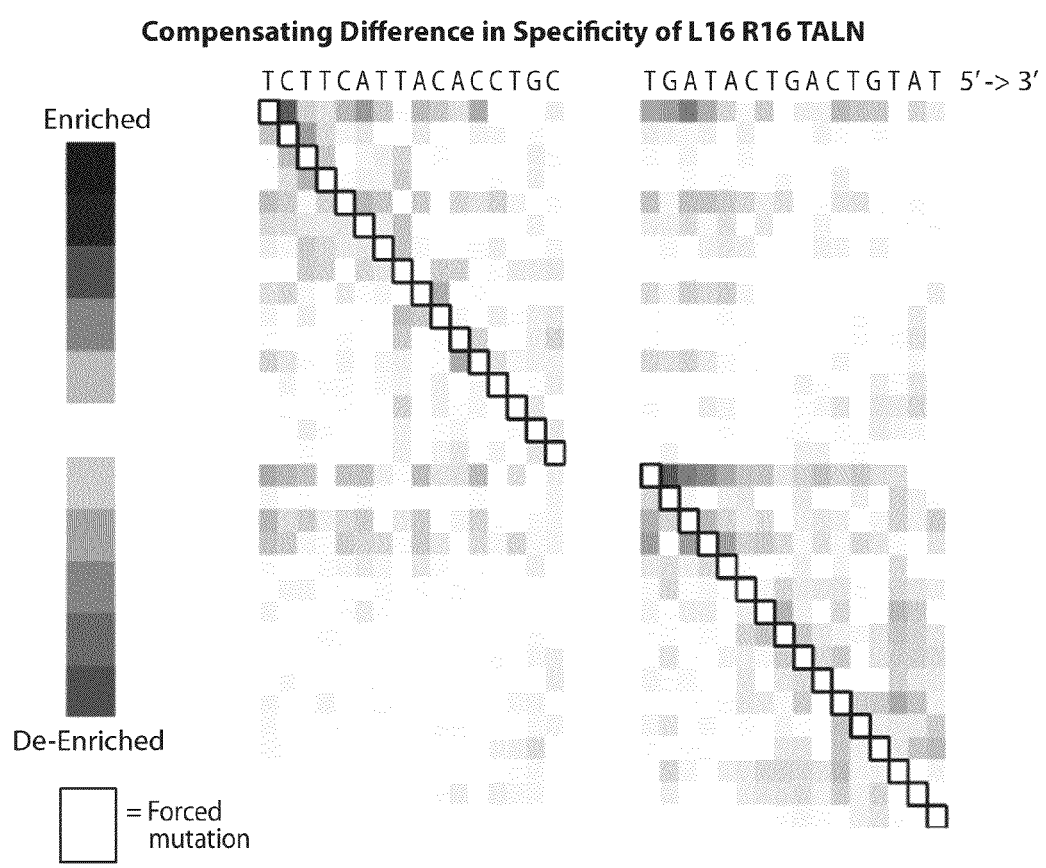
FIG. 42. Compensating Difference in Specificity of L16 R16 TALN. A single mutation in the cleavage site does not alter the distribution of other mutations suggesting that the TAL repeat domains bind independently (SEQ ID NOs:114 and 115).
Figure 43:
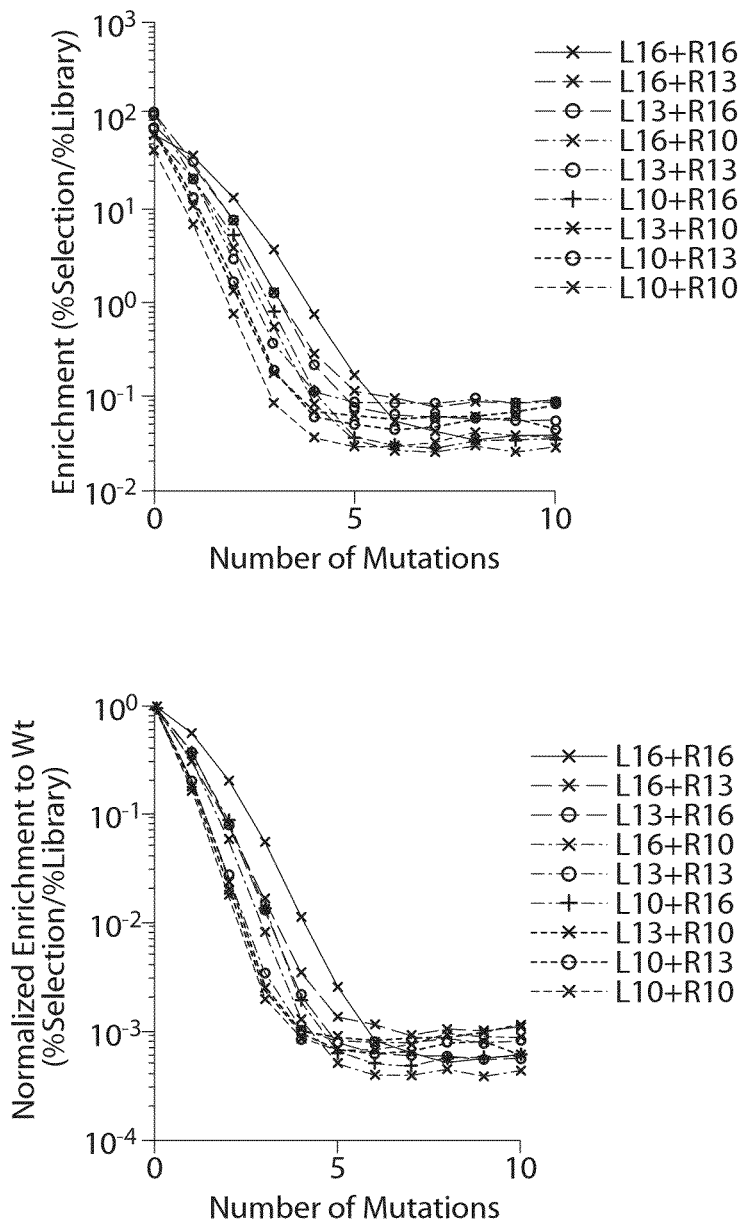
FIG. 43. Enrichment of Mutations in Full, Total Target Site of TALN Pairs. The enrichments seem to have similar log slopes in the low mutation range, the selections containing a TALN recognizing 16 bps seem to be the exceptions indicating R16 binding may be saturating for some very low mutation sites (aka R16 & L16 were near or above the Kd for the wild type site).
Figure 44:
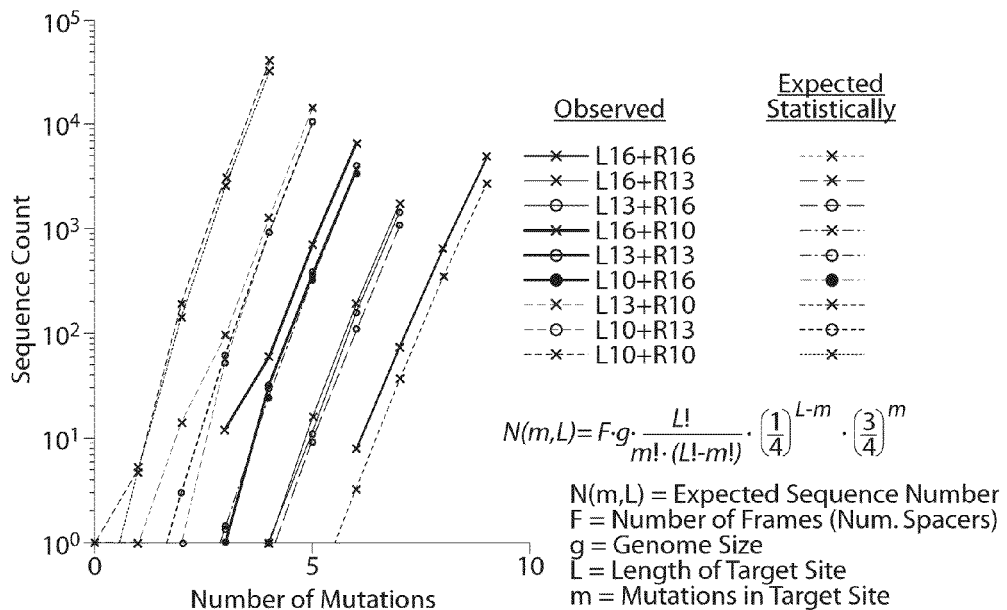
FIG. 44. TALN Off-Target Sites in the Human Genome.
Figure 45:
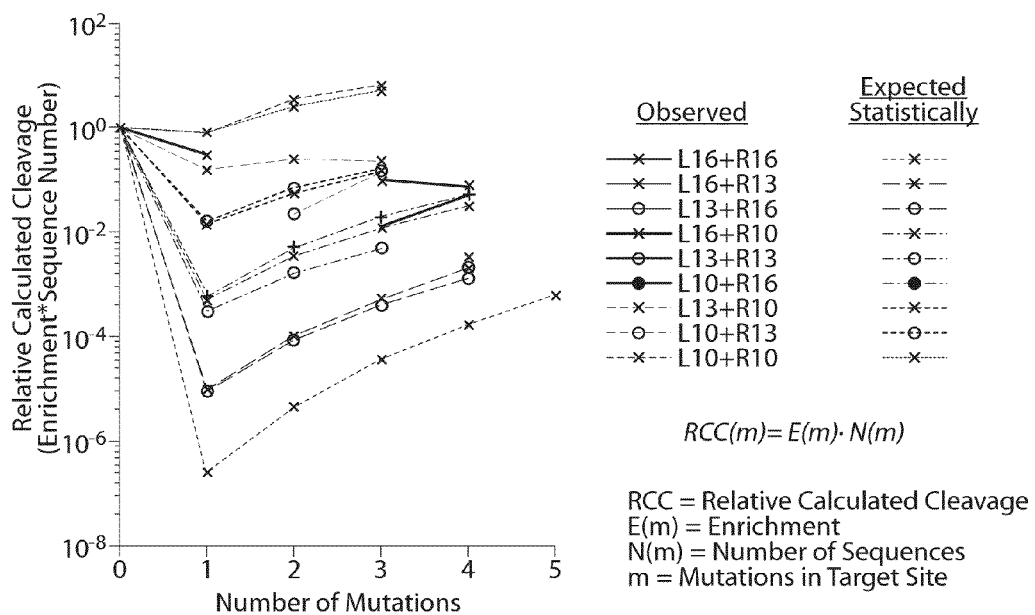
FIG. 45. TALN Off-Target Sites Predicted Cleavage.
Figure 46:
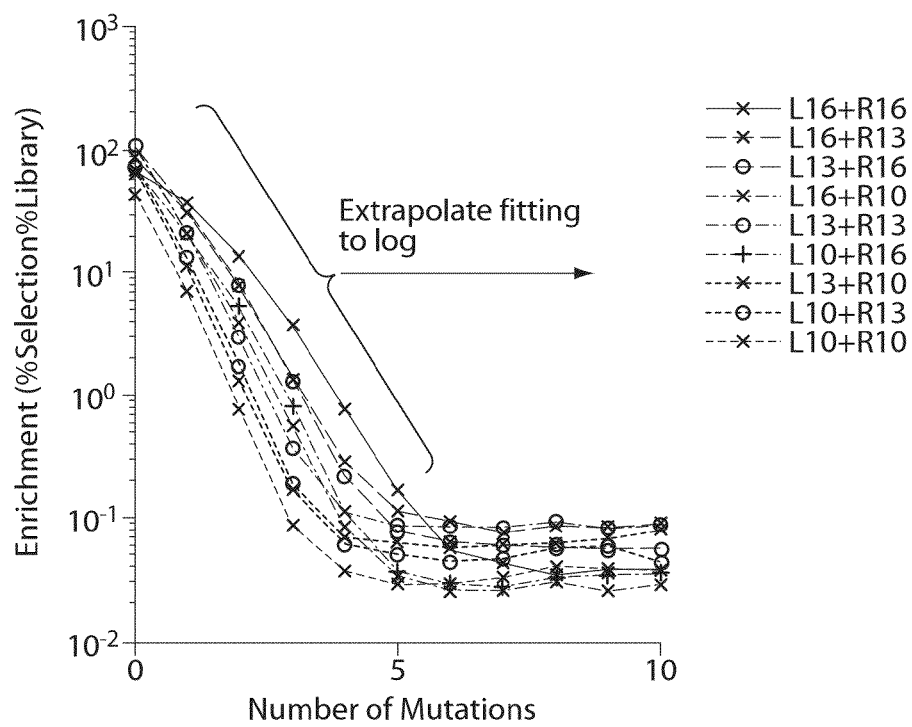
FIG. 46. TALN Off-Target Sites Predicted Cleavage For Very Mutant Target Sites below Detection Limit.
Figure 46:
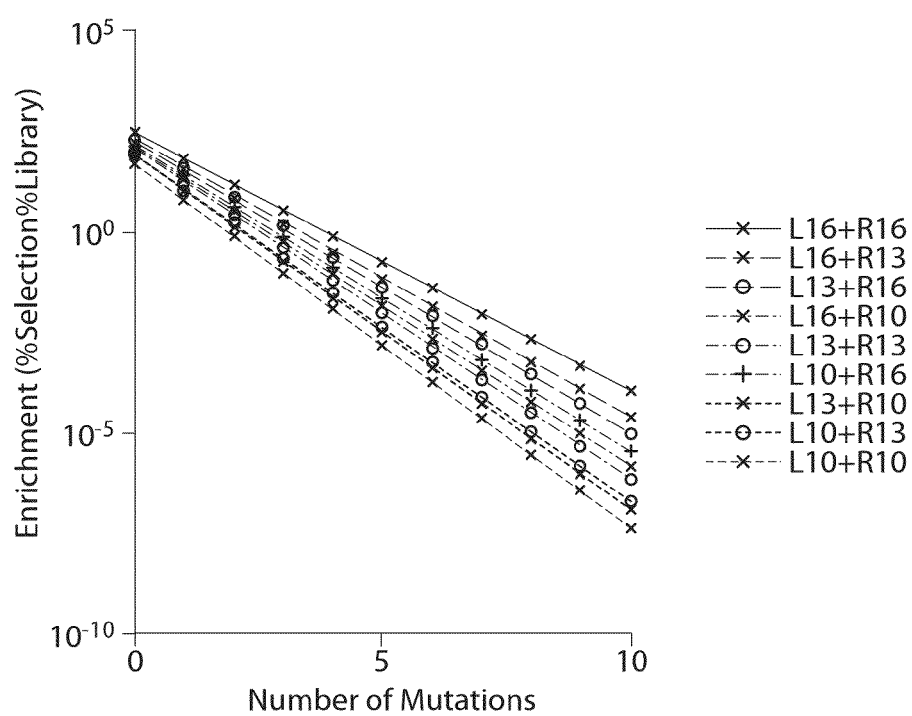
Figure 47:
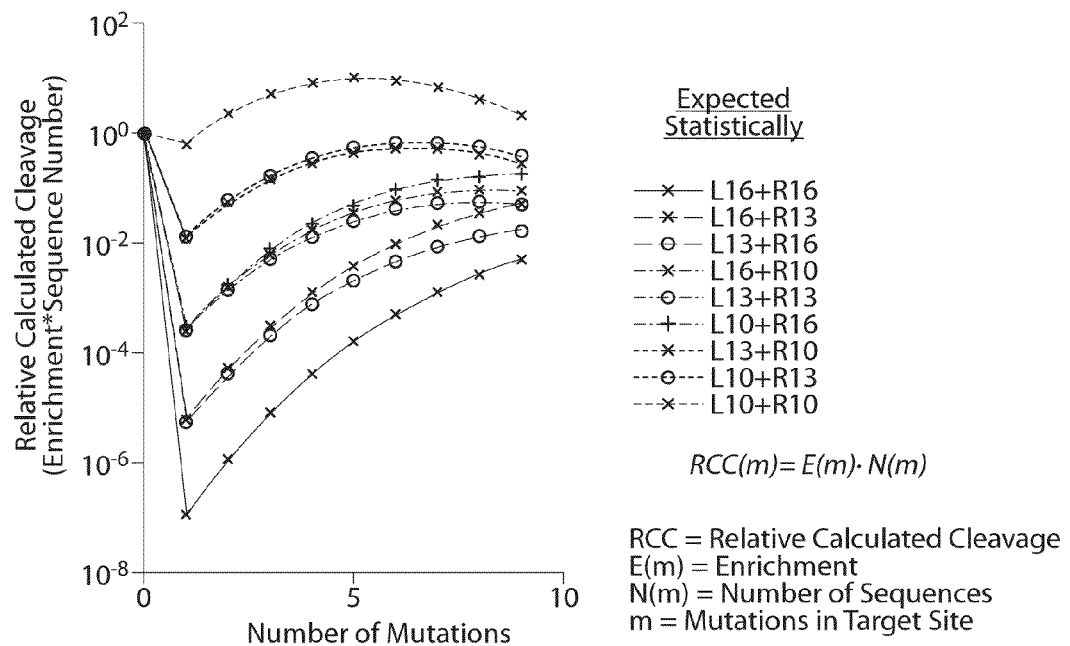
FIG. 47. TALN Off-Target Sites Predicted Cleavage For Very Mutant Target Sites below Detection Limit.
Figure 48:
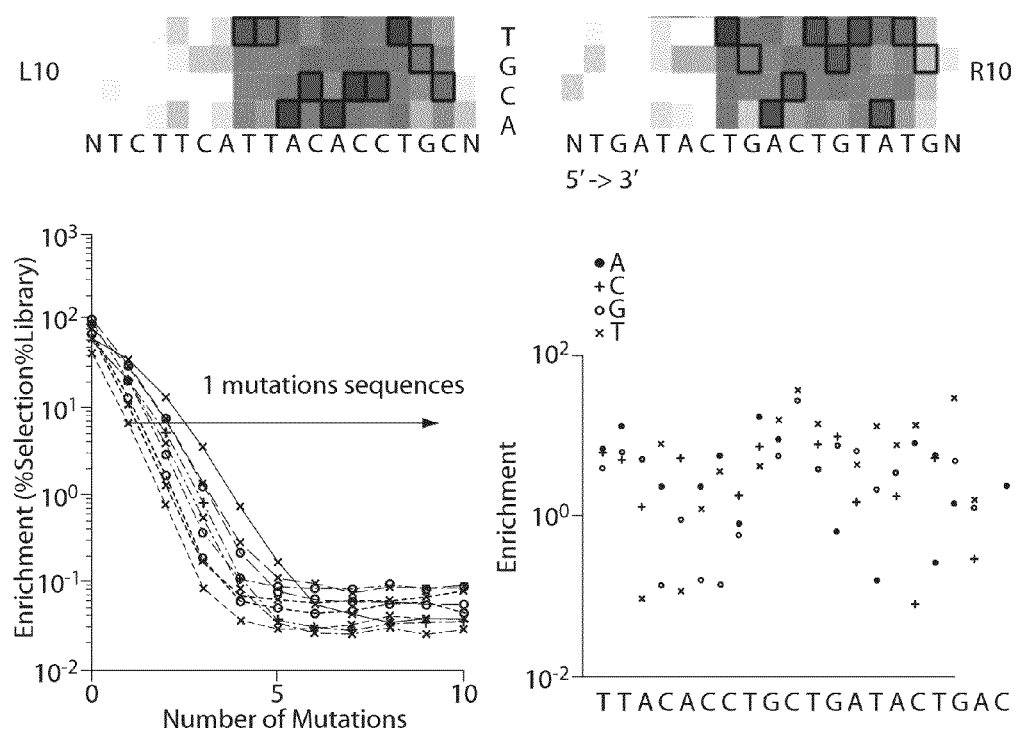
FIG. 48. TALN Off-Target Sites Predicted Cleavage For Sequences (Not just Number of Mutations). Combining the regular log decrease of cleavage efficiency (enrichment) as total target site mutations increase and the enrichment at each position we should be able to predict the off-target site cleavage of any sequence (SEQ ID NOs:116-118).
Figure 49:
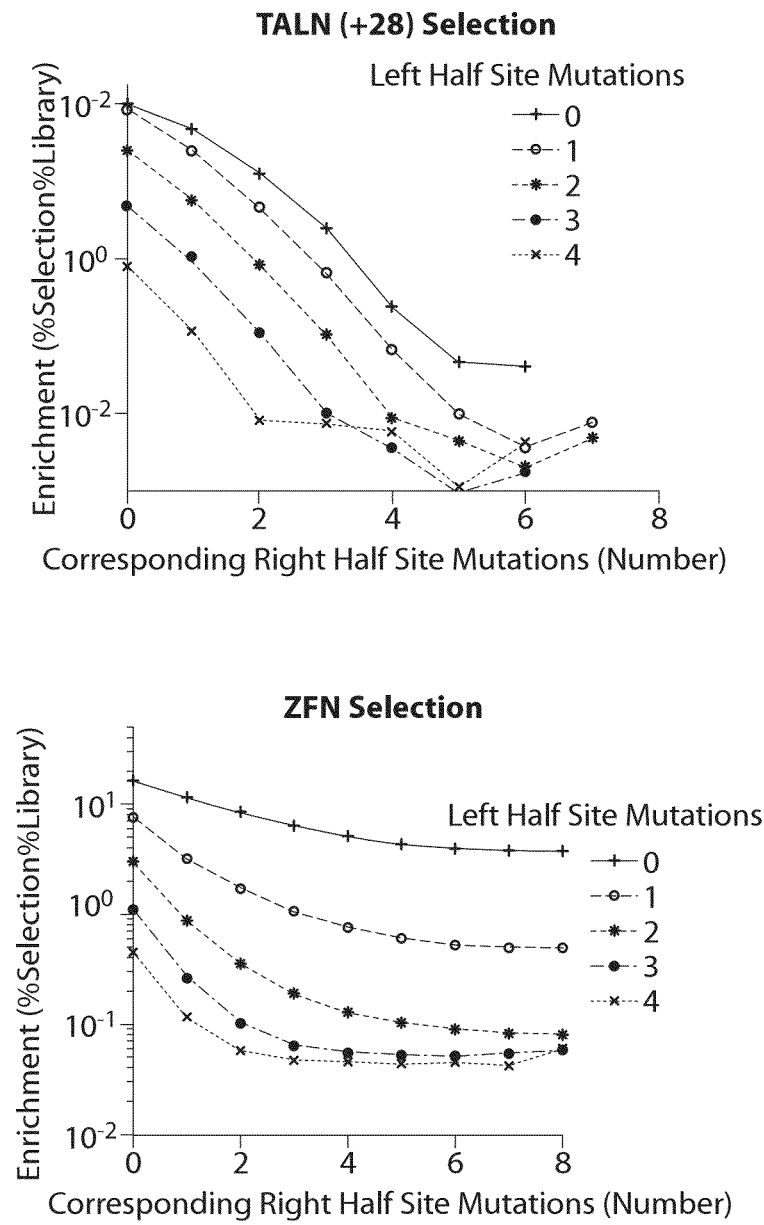
FIG. 49. Comparing TALNs vs. ZFNs. For the most part, in the TALN selection the enrichment is dependent on the total mutations in both half sites and not on the distribution of mutations between half sites like for zinc finger nucleases (ZFN). This observation combined with the context dependent binding of ZFNs potentially make ZFN far less specific than their TAL equivalents.

TAL DNA binding domains are the basis of a transformative technology to specifically modulate target DNA both in vitro and in cells. The designable TAL DNA binding domains have advantages in targetable sequence space and ease of construction compared to other DNA binding domains, for example, zinc fingers. These TAL DNA binding domains are comprised of repeats of a 34 amino acid domain with a highly variable di-amino acid (RVD) coding for recognition of a single base pair in the target DNA sequence (FIG. 20). Based on the robustness of this RVD code and the crystal structure of a TAL bound to its DNA target, it is likely that binding of a single repeat to a base pair is relatively independent of adjacent repeat binding. The TAL DNA binding domain (an array of repeats) can be linked to the monomer of a heterodimeric nuclease domain to form a TAL nuclease. Thus, two distinct TAL nucleases can bind adjacent target half sites to cleave a specific sequence resulting in genome modifications in vivo (FIGS. 19 and 20). While a number of studies have investigated the specificity of TAL DNA binding, to our knowledge no studies have profiled the specificity of TAL nucleases on a large scale. We applied the concept of high-throughput, in vitro selection for nuclease specificity outlined for ZFNs in Example 1 to TAL nucleases to both confirm the modular, independent binding of TAL repeats expected from their easy design-ability and also identify genomic off-target sequences cut by therapeutically relevant TAL nucleases.

The selection scheme for profiling the specificity of TAL nucleases via in vitro library screening was in analogy to the selection scheme described for ZFNs in Example. Detailed protocols are provided below:

Preparation of Library of Partly Randomized Target Sites
2 ul of 10 pmol TALNCCR5 Library Oligo (separate reactions for each oligo)
2 ul 10× CircLigase II 10× Reaction Buffer
1 ul 50 mM MnCl2
1 ul CircLigase II ssDNA Ligase (100 U) [Epicentre]
X ul water to 20 uL total volume
Incubate 16 hrs at 60° C. Incubate 10 min at 85° C. to inactivate.
Add 2.5 ul of each Circligase II reaction (without purification)
Add 25 ul TempliPhi™ [GE Healthcare] 100 sample buffer. Incubate 3 min at 95° C. Slow cool to 4° C.
Add 25 ul TempliPhi™ reaction buffer/1 ul enzyme mix. Incubate 16 hrs at 30° C. Heat inactive 10 min at 55° C.
Quantify amount of dsDNA using Quant-iT™ PicoGreen® dsDNA [Invitrogen]
Combine equal moles of TempliPhi™ reactions to final 2 uM with respect to number of cut sites.
TALN Expression
16 ul TnT® Quick Coupled [Promega]
0.4 ul 1 mM methionine
2 uL of 0.8 ug TALN vector expression plasmid or water for empty lysate
1.6 uL of water
Incubate at 30 for 1.5 hours and then store at 4° C. overnight.
Quantify amount of TALN in lysate via Western Blot.
TALN Digestion
25 uL of 10×NEB Buffer 3 [New England Biolabs]
10 uL of 2 uM TempliPh Library DNA
165 uL water
Add left TALN lysate to 20 nM total left TALN
Add right TALN lysate to 20 nM total right TALN
Add empty lysate to total of 50 uL lysate
Incubate 2 hrs at 37° C. Add 5 ul (50 ug) RNaseA (Qiagen). Incubate 10 min at RT. Purify with Qiagen PCR Purification Kit. Elute in 50 uL of 1 mM Tris, pH 8.0.
Adapter Ligation, PCR and Gel Purification of TALN Digestion
50 ul digested DNA
3 ul dNTP mix
6 ul NEB 2
1 ul Klenow [New England Biolabs]
Incubate 30 min at RT. Purify with Qiagen PCR Purification Kit.
50 ul eluted DNA
5.9 ul T4 DNA Ligase Buffer (NEB)
2 ul (20 pmol) heat/cooled adapter (different adapter for each selection)
1 ul T4 DNA ligase (NEB, 400 units)
Incubate at RT for 20 hrs. Purify with Qiagen PCR Purification Kit.
6 uL of TALN digested DNA
30 uL of 5× Buffer HF
1.5 uL 100 uM Illumina_fwd Primer
1.5 uL 100 uM PE_TALN_rev1 Primer
3 uL 10 mM dNTP
1.5 uL Phusion Hot Start II
106.5 uL of water
98° C. for 3 min, do 15 cycles of 98° C. for 15 s, 60° C. for 15 s, 72° C. for 1 min. Purify with Qiagen PCR Purification Kit Gel Purify on 2% Agarose gel loading 1 ug of eluted DNA in 40 uL of 10% glycerol. Run on gel at 135V for 35 min. Gel purify bands of the length corresponding to a cut half site+full half site+adapter with filter paper. Remove filter paper and collect supernatant. Purify with Qiagen PCR Purification Kit.
6 uL of TALN digested DNA (5-26-12)
30 uL of 5× Buffer HF
1.5 uL 100 uM Illumina_fwd Primer
1.5 uL 100 uM PE_TALN_rev2 Primer
3 uL 10 mM dNTP
1.5 uL Phusion Hot Start II
106.5 uL of water
98° C. for 3 min, do 6 cycles of 98° C. for 15 s, 60° C. for 15 s, 72° C. for 1 min. Purify with Qiagen PCR Purification Kit.
Preparation of Pre-selection Library
25 uL of 10×NEB Buffer 4
10 uL of 2 uM TempliPhi Library DNA
165 uL water
5 uL of Appropriate Restriction Enzyme [New England Biolabs]
210 uL of water
Incubate 1 hrs at 37° C. Purify with Qiagen PCR Purification Kit.
50 ul eluted DNA
5.9 ul T4 DNA Ligase Buffer (NEB)
2 ul (20 pmol) heat/cooled adapter (pool of 4 adapter sequences)
1 ul T4 DNA ligase (NEB, 400 units)
Incubate at RT for 20 hrs. Purify with Qiagen PCR Purification Kit.
6 uL of Restriction Enzyme Digested DNA (5-26-12)
30 uL of 5× Buffer HF
1.5 uL 100 uM Illumina_rev Primer
1.5 uL 100 uM TALNLibPCR Primer
3 uL 10 mM dNTP
1.5 uL Phusion Hot Start II
106.5 uL of water
98° C. for 3 min, 12 cycles of 98° C. for 15 s, 60° C. for 15 s, 72° C. for 1 min. Purify with Qiagen PCR Purification Kit
High-throughput Sequencing
Quantify via RT-qPCR
12.5 uL of IQ SYBR Green Supermix
1 uL of 10 uM Illumina_rev
1 uL of 10 uM Illumina_fwd
9.5 uL of water
1 uL of DNA template (both Pre-Selection Library and TALN Digestion)
95° C. for 5 min, do 30 cycles of 95° C. for 30 s, 65° C. for 30 s, 72° C. for 40 s.
Dilute DNA to 2 nM (compared to sequencing standard)
5 uL of TALN Digestion 2 nM DNA
2.5 uL of Pre-Selection Library 2 nM DNA
10 uL of 0.1N NaOH
Incubate at room temp for 5 min
Sequence via Illumina Mi-Seq
Computational Filtering
For TALN Digested sequences, find two appropriately spaced constant oligo sequences
For Pre-selection Library sequences, find appropriately spaced constant oligo sequence and library adapter sequence
Parse sequence into cut overhang, left half site, spacer, right half site
Remove sequences with poor Illumina base scores in half sites (<B=rejected)

| Primer | Sequence |
| --- | --- |
| J61TALCCR5B_10 | CCACGCTN(N1: 07070779)(N2: 07790707)(N1)(N1)(N2)(N3: 79070707)(N1)(N1)(N3)(N2)(N3)(N2)(N2)(N1)(N4: 07077907)(N2)NNNNNNNNNN(N2)(N3)(N1)(N3)(N2)(N3)(N4)(N1)(N2)(N3)(N4)(N1)(N3)(N1)(N2)(N3)NCCTCGGGACT (SEQ ID NOs:138 and 139; full sequence: SEQ ID NO: 8767) |
| J63TALCCR5B_12 | CCACGCTN(N1: 07070779)(N2: 07790707)(N1)(N1)(N2)(N3: 79070707)(N1)(N1)(N3)(N2)(N3)(N2)(N2)(N1)(N4: 07077907)(N2)NNNNNNNNNNNN(N2)(N3)(N1)(N3)(N2)(N3)(N4)(N1)(N2)(N3)(N4)(N1)(N3)(N1)(N2)(N3)NCCTCGGGACT (SEQ ID NOs:140 and 141; full sequence: SEQ ID NO: 8768) |
| J65TALCCR5B_14 | CCACGCTN(N1: 07070779)(N2: 07790707)(N1)(N1)(N2)(N3: 79070707)(N1)(N1)(N3)(N2)(N3)(N2)(N2)(N1)(N4: 07077907)(N2)NNNNNNNNNNNNNN(N2)(N3)(N1)(N3)(N2)(N3)(N4)(N1)(N2)(N3)(N4)(N1)(N3)(N1)(N2)(N3)NCCTCGGGACT (SEQ ID NOs:142 and 143; full sequence: SEQ ID NO: 8769) |
| J66TALCCR5B_15 | CCACGCTN(N1: 07070779)(N2: 07790707)(N1)(N1)(N2)(N3: 79070707)(N1)(N1)(N3)(N2)(N3)(N2)(N2)(N1)(N4: 07077907)(N2)NNNNNNNNNNNNNNN(N2)(N3)(N1)(N3)(N2)(N3)(N4)(N1)(N2)(N3)(N4)(N1)(N3)(N1)(N2)(N3)NCCTCGGGACT (SEQ ID NOs: 144 and 145; full sequence: SEQ ID NO: 8770) |
| J67TALCCR5B_16 | CCACGCTN(N1: 07070779)(N2: 07790707)(N1)(N1)(N2)(N3: 79070707)(N1)(N1)(N3)(N2)(N3)(N2)(N2)(N1)(N4: 07077907)(N2)NNNNNNNNNNNNNNN N(N2)(N3)(N1)(N3)(N2)(N3)(N4)(N1)(N2)(N3)(N4)(N1)(N3)(N1)(N2)(N3)NCCTCGGGACT (SEQ ID NOs: 146 and 147; full sequence: SEQ ID NO: 8771) |
| J68TALCCR5B_17 | CCACGCTN(N1: 07070779)(N2: 07790707)(N1)(N1)(N2)(N3: 79070707)(N1)(N1)(N3)(N2)(N3)(N2)(N2)(N1)(N4: 07077907)(N2)NNNNNNNNNNNNNNN NN(N2)(N3)(N1)(N3)(N2)(N3)(N4)(N1)(N2)(N3)(N4)(N1)(N3)(N1)(N2)(N3)NCCTCGGGACT (SEQ ID NOs: 148 and 149; full sequence: SEQ ID NO: 8772) |

| Primer sequences | |
|---|---|
| Primer | Sequence |
| J69TALCCR5B_18 | CCACGCTN(N1: 07070779)(N2: 07790707)(N1)(N1)(N2)(N3: 79070707)(N1)(N1)(N3)(N2)(N3)(N2)(N2)(N1)(N4: 07077907)(N2)NNNNNNNNNNNNNNNNNN(N2)(N3)(N1)(N3)(N2)(N3)(N4)(N1)(N2)(N3)(N4)(N1)(N3)(N1)(N2)(N3)NCCTCGGGACT (SEQ ID NOs:150 and 151; full sequence: SEQ ID NO: 8773) |
| J71TALCCR5B_20 | CCACGCTN(N1: 07070779)(N2: 07790707)(N1)(N1)(N2)(N3: 79070707)(N1)(N1)(N3)(N2)(N3)(N2)(N2)(N1)(N4: 07077907)(N2)NNNNNNNNNNNNNNNNNNNN(N2)(N3)(N1)(N3)(N2)(N3)(N4)(N1)(N2)(N3)(N4)(N1)(N3)(N1)(N2)(N3)NCCTCGGGACT (SEQ ID NOs: 152 and 153; full sequence: SEQ ID NO: 8774) |
| J73TALCCR5B_22 | CCACGCTN(N1: 07070779)(N2: 07790707)(N1)(N1)(N2)(N3: 79070707)(N1)(N1)(N3)(N2)(N3)(N2)(N2)(N1)(N4: 07077907)(N2)NNNNNNNNNNNNNNNNNNNNNN(N2)(N3)(N1)(N3)(N2)(N3)(N4)(N1)(N2)(N3)(N4)(N1)(N3)(N1)(N2)(N3)NCCTCGGGACT (SEQ ID NOs: 154 and 155; full sequence: SEQ ID NO: 8775) |
| J75TALCCR5B_24 | CCACGCTN(N1: 07070779)(N2: 07790707)(N1)(N1)(N2)(N3: 79070707)(N1)(N1)(N3)(N2)(N3)(N2)(N2)(N1)(N4: 07077907)(N2)NNNNNNNNNNNNNNNNNNNNNNNN(N2)(N3)(N1)(N3)(N2)(N3)(N4)(N1)(N2)(N3)(N4)(N1)(N3)(N1)(N2)(N3)NCCTCGGGACT (SEQ ID NOs: 156 and 157; full sequence: SEQ ID NO: 8776) |
| CGTAAadapterfwd | AATGATACGGCGACCACCGAGATCTACACTCTTTCCCTACACGACGCTCTTCCGATCTCGTAA (SEQ ID NO: 158) |
| CGTAAadapterREV | TTACGAGATCGGAAGAGCGTCGTGTAGGGAAAGAGTGTAGATCTCGGTGG (SEQ ID NO: 159) |
| GTACTadapterfwd | AATGATACGGCGACCACCGAGATCTACACTCTTTCCCTACACGACGCTCTTCCGATCTGTACT (SEQ ID NO: 160) |
| GTACTadapterREV | AGTACAGATCGGAAGAGCGTCGTGTAGGGAAAGAGTGTAGATCTCGGTGG (SEQ ID NO: 161) |
| TACGAadapterfwd | AATGATACGGCGACCACCGAGATCTACACTCTTTCCCTACACGACGCTCTTCCGATCTTACGA (SEQ ID NO: 162) |
| TACGAadapterREV | TCGTAAGATCGGAAGAGCGTCGTGTAGGGAAAGAGTGTAGATCTCGGTGG (SEQ ID NO: 163) |
| ATGCTadapterfwd | AATGATACGGCGACCACCGAGATCTACACTCTTTCCCTACACGACGCTCTTCCGATCTATGCT (SEQ ID NO: 164) |
| ATGCTadapterREV | AGCATAGATCGGAAGAGCGTCGTGTAGGGAAAGAGTGTAGATCTCGGTGG (SEQ ID NO: 165) |
| TGCAAadapterfwd | AATGATACGGCGACCACCGAGATCTACACTCTTTCCCTACACGACGCTCTTCCGATCTTGCAA (SEQ ID NO: 166) |
| TGCAAadapterREV | TTGCAAGATCGGAAGAGCGTCGTGTAGGGAAAGAGTGTAGATCTCGGTGG (SEQ ID NO: 167) |
| GCATTadapterfwd | AATGATACGGCGACCACCGAGATCTACACTCTTTCCCTACACGACGCTCTTCCGATCTGCATT (SEQ ID NO: 168) |
| GCATTadapterREV | AATGCAGATCGGAAGAGCGTCGTGTAGGGAAAGAGTGTAGATCTCGGTGG (SEQ ID NO: 169) |
| GACTAadapterfwd | AATGATACGGCGACCACCGAGATCTACACTCTTTCCCTACACGACGCTCTTCCGATCTGACTA (SEQ ID NO: 170) |
| GACTAadapterREV | TAGTCAGATCGGAAGAGCGTCGTGTAGGGAAAGAGTGTAGATCTCGGTGG (SEQ ID NO: 171) |
| ACTGTadapterfwd | AATGATACGGCGACCACCGAGATCTACACTCTTTCCCTACACGACGCTCTTCCGATCTACTGT (SEQ ID NO: 172) |
| ACTGTadapterREV | ACAGTAGATCGGAAGAGCGTCGTGTAGGGAAAGAGTGTAGATCTCGGTGG (SEQ ID NO: 173) |
| CTGAAadapterfwd | AATGATACGGCGACCACCGAGATCTACACTCTTTCCCTACACGACGCTCTTCCGATCTCTGAA (SEQ ID NO: 174) |

-continued

Primer sequences

| Primer | Sequence |
| --- | --- |
| CTGAAadapterREV | TTCAGAGATCGGAAGAGCGTCGTGTAGGGAAAGAGTGTAGATCTCG GTGG (SEQ ID NO: 175) |
| PE_TALCCR5B_rev1 | CAAGCAGAAGACGGCATACGAGATCGTGATGTGACTGGAGTTCAGA CGTGTGCTCTTCCG (SEQ ID NO: 176) |
| PE_TALCCR5B_rev2 | CAGACGTGTGCTCTTCCGATCNNNNAGCGTGGAGTCCCGAGG (SEQ ID NO: 177) |
| PE_TALCCR5B_rev | CAAGCAGAAGACGGCATACGAGATACAGTCGTGACTGGAGTTCAGA CGTGTGCTCTTCCGATCNNNNAGCGTGGAGTCCCGAGG (SEQ ID NO: 178) |
| PE_TALCCR5Blib adapter1 | TCGGGAACGTGATCGGAAGAGCACACGTCTGAACTCCAGTCACCGT CTAATCTCGTATGCCGTCTTCTGCTTG (SEQ ID NO: 179) |
| PE_TALCCR5Blib adapterrev1 | GTGACTGGAGTTCAGACGTGTGCTCTTCCGATCACGTT (SEQ ID NO: 180) |
| PE_TALCCR5Blib adapter2 | TCGGGACGTAGATCGGAAGAGCACACGTCTGAACTCCAGTCACCGT CTAATCTCGTATGCCGTCTTCTGCTTG (SEQ ID NO: 181) |
| PE_TALCCR5Blib adapterrev2 | GTGACTGGAGTTCAGACGTGTGCTCTTCCGATCTACGT (SEQ ID NO: 182) |
| PE_TALCCR5Blib adapter3 | TCGGGAGTACGATCGGAAGAGCACACGTCTGAACTCCAGTCACCGT CTAATCTCGTATGCCGTCTTCTGCTTG (SEQ ID NO: 183) |
| PE_TALCCR5Blib adapterrev3 | GTGACTGGAGTTCAGACGTGTGCTCTTCCGATCGTACT (SEQ ID NO: 184) |
| PE_TALCCR5Blib adapter4 | TCGGGATACGGATCGGAAGAGCACACGTCTGAACTCCAGTCACCGT CTAATCTCGTATGCCGTCTTCTGCTTG (SEQ ID NO: 185) |
| PE_TALCCR5Blib adapterrev4 | GTGACTGGAGTTCAGACGTGTGCTCTTCCGATCCGTAT (SEQ ID NO: 186) |
| TALCCR5BlibPCR | AATGATACGGCGACCACCGAGATCTACACTCTTTCCCTACACGACG CTCTTCCGATCTNNNNCCTCGGGACTCCACGCT (SEQ ID NO: 187) |
| IlluminaFwd | AATGATACGGCGACCAC (SEQ ID NO: 188) |
| IlluminaRev | CAAGCAGAAGACGGCATACGA (SEQ ID NO: 189) |

Conclusions

The relatively regular (log relationship) trend between number of half sites mutations and enrichment is consistent with a single TAL repeat binding a base pair independent of other repeat binding. A single mutation in the cleavage site does not significantly alter the distribution of other mutations in the compensation difference analysis suggesting that the TAL repeat domains bind independently. The +28 linker is more specific than the +63 linker TALN constructs. While TALNs recognizing larger target sites are less specific in that they can tolerate more mutations, the abundance of the mutant larger sequences is less than the increase in enrichment, thus the in vitro selection data and abundance of off-target sites indicates off-target cleavage to be significantly less likely in longer TALN pairs. Combining the regular decrease of cleavage efficiency (enrichment) as total target site mutations increase and the enrichment at each position it is possible to predict the off-target site cleavage of any sequence. For the most part, in the TALN selection the enrichment was dependent on the total mutations in both half sites and not on the distribution of mutations between half sites as was observed for zinc finger nucleases (ZFN). This observation combined with the context dependent binding of ZFNs indicated that TALENs may readily be engineered to a specificity as high or higher than their ZFN equivalents.

All publications, patents and sequence database entries mentioned herein, including those items listed above, are hereby incorporated by reference in their entirety as if each individual publication or patent was specifically and individually indicated to be incorporated by reference. In case of conflict, the present application, including any definitions herein, will control.

EQUIVALENTS AND SCOPE

Those skilled in the art will recognize, or be able to ascertain using no more than routine experimentation, many equivalents to the specific embodiments of the invention described herein. The scope of the present invention is not intended to be limited to the above description, but rather is as set forth in the appended claims.

In the claims articles such as "a," "an," and "the" may mean one or more than one unless indicated to the contrary or otherwise evident from the context. Claims or descriptions that include "or" between one or more members of a group are considered satisfied if one, more than one, or all of the group members are present in, employed in, or otherwise relevant to a given product or process unless indicated to the contrary or otherwise evident from the context. The invention includes embodiments in which exactly one member of the group is present in, employed in, or otherwise relevant to a given product or process. The invention also includes embodiments in which more than one, or all of the group members are present in, employed in, or otherwise relevant to a given product or process.

Furthermore, it is to be understood that the invention encompasses all variations, combinations, and permutations in which one or more limitations, elements, clauses, descriptive terms, etc., from one or more of the claims or from relevant portions of the description is introduced into another claim. For example, any claim that is dependent on another claim can be modified to include one or more limitations found in any other claim that is dependent on the same base claim. Furthermore, where the claims recite a composition, it is to be understood that methods of using the composition for any of the purposes disclosed herein are included, and methods of making the composition according to any of the methods of making disclosed herein or other methods known in the art are included, unless otherwise indicated or unless it would be evident to one of ordinary skill in the art that a contradiction or inconsistency would arise.

Where elements are presented as lists, e.g., in Markush group format, it is to be understood that each subgroup of the elements is also disclosed, and any element(s) can be removed from the group. It is also noted that the term "comprising" is intended to be open and permits the inclusion of additional elements or steps. It should be understood that, in general, where the invention, or aspects of the invention, is/are referred to as comprising particular elements, features, steps, etc., certain embodiments of the invention or aspects of the invention consist, or consist essentially of, such elements, features, steps, etc. For purposes of simplicity those embodiments have not been specifically set forth in haec verba herein. Thus for each embodiment of the invention that comprises one or more elements, features, steps, etc., the invention also provides embodiments that consist or consist essentially of those elements, features, steps, etc.

Where ranges are given, endpoints are included. Furthermore, it is to be understood that unless otherwise indicated or otherwise evident from the context and/or the understanding of one of ordinary skill in the art, values that are expressed as ranges can assume any specific value within the stated ranges in different embodiments of the invention, to the tenth of the unit of the lower limit of the range, unless the context clearly dictates otherwise. It is also to be understood that unless otherwise indicated or otherwise evident from the context and/or the understanding of one of ordinary skill in the art, values expressed as ranges can assume any subrange within the given range, wherein the endpoints of the subrange are expressed to the same degree of accuracy as the tenth of the unit of the lower limit of the range.

In addition, it is to be understood that any particular embodiment of the present invention may be explicitly excluded from any one or more of the claims. Where ranges are given, any value within the range may explicitly be excluded from any one or more of the claims. Any embodiment, element, feature, application, or aspect of the compositions and/or methods of the invention, can be excluded from any one or more claims. For purposes of brevity, all of the embodiments in which one or more elements, features, purposes, or aspects is excluded are not set forth explicitly herein.

TABLES

| mutations T | (+) | (−) | gene | (+) half-site (SEQ ID NOs: 190-226) | spacer | (−) half-site (SEQ ID NOs: 227-263) | in vitro selection stringency (nM) 4 | 2 | 1 | 0.5 | K562 modification frequency |
|---|---|---|---|---|---|---|---|---|---|---|---|
| 0 | 0 | 0 | CCR5 (coding) | GTCATCCTCATC | CTGAT | AAACTGCAAAAG | X | X | X | X | 1 : 23 |
| 2 | 1 | 1 | CCR2 (coding) | GTCgTCCTCATC | TTAAT | AAACTGCAAAAa | X | X | X | X | 1 : 10 |
| 3 | 2 | 1 | BTBD10 (promoter) | GTttTCCTCATC | AAAGC | AAACTGCAAAAt | X | X | | | 1 : 1,400 |
| 4 | 0 | 4 | | GTCATCCTCATC | AGAGA | AAACTGgctAAt | X | X | | | n.d. |
| 4 | 3 | 1 | SLC4A8 | taaATCCTCATC | TCTATA | AAAaTGCAAAAG | X | X | | | n.d. |
| 3 | 2 | 1 | Z83955 RNA | GTCATCCcaATC | GAAGAA | AAACTGaAAAAG | X | | | X | n.d. |
| 3 | 1 | 2 | DGKK | cTCATCCTCATC | CATGC | AcAaTGCAAAAG | X | | | | n.d. |
| 3 | 1 | 2 | GALNT13 | GTCATCCTCAgC | ATGGG | AAACaGCAgAAG | X | | | | n.d. |
| 3 | 1 | 2 | | GTCATCtTCATC | AAAAG | gAACTGCAAAAc | X | | | | 1 : 2,800 |
| 4 | 0 | 4 | | GTCATCCTCATC | CAATA | AAAgaaCAAAgG | X | | | | n.d. |
| 4 | 1 | 3 | TACR3 | GTCATCtTCATC | AGCAT | AAACTGtAAAgt | X | | | | 1 : 300 |

-continued

| mutations T | (+) | (−) | gene | (+) half-site (SEQ ID NOs: 190-226) | spacer | (−) half-site (SEQ ID NOs: 227-263) | in vitro selection stringency (nM) 4 | 2 | 1 | 0.5 | K562 modification frequency |
|---|---|---|---|---|---|---|---|---|---|---|---|
| 4 | 1 | 3 | PIWIL2 | GTCATCCTCATa | CATAA | AAACTGCcttAG | X | | | | |
| 4 | 1 | 3 | | aTCATCCTCATC | CATCC | AAtgTtCAAAAG | X | | | | n.d. |
| 4 | 3 | 1 | | GTCcTgCTCAgC | AAAAG | AAACTGaAAAAG | X | | | | 1 : 4,000 |
| 4 | 3 | 1 | KCNB2 | aTgtTCCTCATC | TCCCG | AAACTGCAAAtG | X | | | | 1 : 1,400 |
| 4 | 3 | 1 | | GTCtTCCTgATg | CTACC | AAACTGgAAAAG | X | | | | 1 : 5,300 |
| 4 | 3 | 1 | | aaCATCCaCATC | ATGAA | AAACTGCAAAAa | X | | | | n.d. |
| 6 | 3 | 3 | | aTCtTCCTCATt | ACAGG | AAAaTGtAAtAG | X | | | | n.d. |
| 6 | 4 | 2 | CUBN | GgCtTCCTgAcC | CACGG | AAACTGtAAAtG | X | | | | |
| 6 | 5 | 1 | NID1 | GTttTgCaCATt | TCAAT | tAACTGCAAAAG | X | | | | n.d. |
| 3 | 2 | 1 | | GTCAaCCTCAaC | ACCTAC | AgACTGCAAAAG | X | | | | 1 : 1,700 |
| 4 | 1 | 3 | WWOX | GTCATCCTCcTC | CAACTC | cAAtTGCtAAAG | X | | | | n.d. |
| 4 | 2 | 2 | AMBRA1 | GTCtTCCTCcTC | TGCACA | tcACTGCAAAAG | X | | | | n.d. |
| 4 | 2 | 2 | | GTgATaCTCATC | ATCAGC | AAtCTGCAtAAG | X | | | | n.d. |
| 4 | 2 | 2 | WBSCR17 | GTtATCCTCAgC | AAACTA | AAACTGgAAcAG | X | | | | 1 : 860 |
| 4 | 2 | 2 | ITSN | cTCATgCTCATC | ATTTGT | tAACTGCAAAAt | X | | | | n.d. |
| 4 | 4 | 0 | | GcCAgtCTCAgC | ATGGTG | AAACTGCAAAAG | X | | | | n.d. |
| 4 | 4 | 0 | | cTCATtCTgtTC | ATGAAA | AAACTGCAAAAG | X | | | | n.d. |
| 5 | 3 | 2 | | GaagTCCTCATC | CCGAAG | AAACTGaAAgAG | X | | | | n.d. |
| 5 | 3 | 2 | ZNF462 | GTCtTCCTCtTt | CACATA | AAACcGCAAAtG | X | | | | n.d. |
| 5 | 4 | 1 | | aTaATCCTtttC | TGTTTA | AAACaGCAAAAG | X | | | | n.d. |
| 5 | 4 | 1 | | GaCATCCaaATt | ACATGG | AAACTGaAAAAG | X | | | | n.d. |
| 5 | 5 | 0 | SDK1 | GTCtTgCTgtTg | CACCTC | AAACTGCAAAAG | X | | | | n.d. |
| 4 | 1 | 3 | SPTB(coding) | GTCATCCgCATC | GCCCTG | gAACTGgAAAAa | | X | | | n.d. |
| 4 | 2 | 2 | | aTCATCCTCAaC | AAACTA | AAACaGgAAAAG | | X | | | |
| 4 | 4 | 0 | KIAA1680 | GgaATgCcCATC | ACCACA | AAACTGCAAAAG | | X | | | n.d. |
| 5 | 5 | 0 | | GTttTgCTCcTg | TACTTC | AAACTGCAAAAG | | X | | | n.d. |

Table 1. CCR5-224 off-target sites in the genome of human K562 cells. Lower case letters indicate mutations compared to the target site. Sites marked with an 'X' were found in the corresponding in vitro selection dataset. 'T' refers to the total number of mutations in the site, and '(+)' and '(−)' to the number of mutations in the (+) and (−) half-sites, respectively. The sequences of the sites are listed as 5' (+) half-site/spacer/(−) half-site 3', therefore the (+) half-site is listed in the reverse sense as it is in the sequence profiles. K562 modification frequency is the frequency of observed sequences showing significant evidence of non-homologous end joining repair (see Methods) in cells expressing active ZFN compared to cells expressing empty vector. Sites that did not show statistically significant evidence of modifications are listed as not detected (n.d.), and K562 modification frequency is left blank for the three sites that were not analyzed due to non-specific PCR amplification from the genome. Table 4 shows the sequence counts and P-values for the tested sites used to determine K562 modification frequency, and Table 6 shows the modified sequences obtained for each site.

|  | Total Sequences | Analyzed Sequences | Rejected Sequences | | |
|---|---|---|---|---|---|
|  |  |  | Incompatible Overhangs | Repeated Sequences | Uncalled Bases in Half-Sites |
| CCR5-224 Pre-Selection | 1,426,442 | 1,392,576 | 0 | 33,660 | 206 |
| CCR5-224 0.5 nM | 649,348 | 52,552 | 209,442 | 387,299 | 55 |
| CCR5-224 1 nM | 488,798 | 55,618 | 89,672 | 343,442 | 66 |
| CCR5-224 2 nM | 1,184,523 | 303,462 | 170,700 | 710,212 | 149 |
| CCR5-224 4 nM | 1,339,631 | 815,634 | 352,888 | 170,700 | 159 |
| Total | 5,088,742 | 2,619,842 | 822,702 | 1,645,563 | 635 |
| VF2468 Pre-Selection | 1,431,372 | 1,393,153 | 0 | 38,128 | 91 |
| VF2468 0.5 nM | 297,650 | 25,851 | 79,113 | 192,671 | 15 |
| VF2468 1 nM | 148,556 | 24,735 | 19,276 | 104,541 | 4 |
| VF2468 2 nM | 1,362,058 | 339,076 | 217,475 | 805,433 | 74 |
| VF2468 4 nM | 1,055,972 | 397,573 | 376,364 | 281,991 | 44 |
| Total | 4,295,608 | 2,180,388 | 692,228 | 1,422,764 | 228 |

Table 2: Sequencing statistics. The total number of interpretable sequences ("total sequences") and the number of analyzed sequences for each in vitro selection condition are shown. Analyzed sequences are non-repeated sequences containing no ambiguous nucleotides that, for post-selection sequences, contained reverse complementary overhang sequences of at least four bases, a signature used in this study as a hallmark of ZFN-mediated cleavage. "Incompatible overhangs" refer to sequences that did not contain reverse complementary overhang sequences of at least four bases. The high abundance of repeated sequences in the 0.5 nM, 1 nM, and 2 nM selections indicate that the number of sequencing reads obtained in those selections, before repeat sequences were removed, was larger than the number of individual DNA sequences that survived all experimental selection steps.

Table 3: Both ZFNs tested have the ability to cleave a large fraction of target sites with three or fewer mutations. The percentage of the set of sequences with 1, 2, or 3 mutations (muts) that can be cleaved by (a) the CCR5-224 ZFN and (b) the VF2468 ZFN is shown. Enrichment factors (EFs) were calculated for each sequence identified in the selection by dividing the observed frequency of that sequence in the post-selection sequenced library by the observed frequency of that sequence in the preselection library. The enrichment factors for the wild-type sequence (wt EFs) calculated for each in vitro selection stringency are shown in the first row of the table.

a

| CCR5-224 | 4 nM (wt EF = 5.48) | | | 2 nM (wt EF = 8.11) | | | 1 nM (wt EF = 16.6) | | | 0.5 nM (wt EF = 24.9) | | |
|---|---|---|---|---|---|---|---|---|---|---|---|---|
|  | 1 mut | 2 muts | 3 muts | 1 mut | 2 muts | 3 muts | 1 mut | 2 muts | 3 muts | 1 mut | 2 muts | 3 muts |
| EF > 0 | 100% | 99.98% | 76% | 100% | 99% | 49% | 100% | 83% | 14% | 100% | 75% | 11% |
| EF > 1 | 100% | 93% | 55% | 100% | 84% | 42% | 100% | 68% | 14% | 100% | 58% | 11% |
| EF > 2 | 100% | 78% | 37% | 100% | 70% | 31% | 99% | 55% | 14% | 96% | 46% | 11% |
| EF > (.5 × wt EF) | 100% | 63% | 28% | 93% | 40% | 17% | 51% | 15% | 8% | 31% | 8% | 4% |
| EF > wt EF | 14% | 9% | 10% | 8% | 6% | 6% | 3% | 2% | 3% | 6% | 1% | 2% | b

| VF2468 | 4 nM (wt EF = 16.7) | | | 2 nM (wt EF = 22.5) | | | 1 nM (wt EF = 30.2) | | | 0.5 nM (wt EF = 33.1) | | |
|---|---|---|---|---|---|---|---|---|---|---|---|---|
|  | 1 mut | 2 muts | 3 muts | 1 mut | 2 muts | 3 muts | 1 mut | 2 muts | 3 muts | 1 mut | 2 muts | 3 muts |
| EF > 0 | 100% | 95% | 38% | 100% | 92% | 26% | 100% | 47% | 5% | 100% | 44% | 4% |
| EF > 1 | 98% | 49% | 17% | 93% | 34% | 11% | 83% | 24% | 5% | 80% | 21% | 4% |
| EF > 2 | 89% | 31% | 10% | 83% | 23% | 7% | 74% | 17% | 5% | 61% | 14% | 4% |
| EF > (.5 × wt EF) | 57% | 15% | 4% | 30% | 10% | 2% | 11% | 6% | 1% | 9% | 5% | 1% |
| EF > wt EF | 7% | 1% | 1% | 7% | 1% | 0.4% | 7% | 1% | 0.4% | 7% | 1% | 0.3% |

| | mutations T (+) (−) | | | gene | build 36 coordinates | (+) half-site | spacer | (−) half-site |
|---|---|---|---|---|---|---|---|---|
| CCR5-224 1 | 0 | 0 | 0 | CCR5 (coding) | chr3: 48399548-46389578 | GTCATCCTCATC | CIGAT | AAACTGCAAAAG |
| CCR5-224 2 | 2 | 1 | 1 | CCR2 (coding) | chr3: 46374209-46374237 | GTCgTCCTCATC | TTAAT | AAACTGCAAAAA |
| CCR5-224 3 | 3 | 2 | 1 | BTBD10 (promoter) | chr11: 13441738-13441766 | GTttTCCTCTATC AAAGC | | AAACTGCAAAAt |
| CCR5-224 4 | 4 | 0 | 4 | | chr10: 29604352-29604380 | GTCATCCTCATC | AGAGA | AAACTGgctAAt |
| CCR5-224 5 | 4 | 3 | 1 | SILC4A8 | chr12: 50186653-50186682 | taaATCCTCATC | TCTATA | AAAaTGCAAAAG |
| CCR5-224 6 | 3 | 2 | 1 | Z83955 RNA | chr12: 33484433-33484462 | GTCATCCcaATC | GAAGAA | AAACTGaAAAAG |
| CCR5-224 7 | 3 | 1 | 2 | DGKK | chrX: 50149961-50149989 | cTCATCCTCATC | CATGC | AcAaTGCAAAAG |
| CCR5-224 8 | 3 | 1 | 2 | GALNT13 | chr2: 154567664-154567692 | GTCATCCTCAgC | ATGGG | AAACaGCAgAAG |
| CCR5-224 9 | 3 | 1 | 2 | | chr17: 61624429-51624457 | GTCATCtTCATC | AAAAG | gAACTGCAAAAc |
| CCR5-224 10 | 4 | 0 | 4 | | chrX: 145275453-145275481 | GTCATCCTCATC | CAATA | AAAgaaCAAAgG |
| CCR5-224 11 | 4 | 1 | 3 | TACR3 | chr4: 104775175-104775203 | GTCATCtTCATC | AGCAT | AAACTGtAAAgt |
| CCR5-224 12 | 4 | 1 | 3 | PIWIL2 | chr8: 22191670-22191698 | GTCATCCTCATa | CATAA | AAACTGCcttAG |
| CCR5-224 13 | 4 | 1 | 3 | | chr9: 76194351-76194379 | aTCATCCTCATC | CATCC | AAtgTtCAAAAG |
| CCR5-224 14 | 4 | 3 | 1 | | chr8: 52114315-52114343 | GTCcTgCTCAgC | AAAAC | AAACTGaAAAAG |
| CCR5-224 15 | 4 | 3 | 1 | KCNB2 | chr8: 73399370-73899398 | aTgtTCCTCATC | TCCCG | AAACTGCAAAtG |
| CCR5-224 16 | 4 | 3 | 1 | | chr8: 4865886-4865914 | GTCtTCCTgATg | CTACC | AAACTGgAAAAG |
| CCR5-224 17 | 4 | 3 | 1 | | chr9: 14931072-14931100 | aaCATCCaCATC | ATGAA | AAACTGCAAAAa |
| CCR5-224 18 | 6 | 3 | 3 | | chr13: 65537258-65537286 | aTCtTCCTCATt | ACAGG | AAAaTGtAAtAG |
| CCR5-224 19 | 6 | 4 | 2 | CUBN | chr10: 17044849-17044877 | GgCtTCCTgAcC | CACGG | AAACTGtAAAtG |
| CCR5-224 20 | 6 | 5 | 1 | NID1 | chr1: 234244827-234244855 | GTtttTgCaCATt | TCAAT | tAACTGCAAAAG |
| CCR5-224 21 | 3 | 2 | 1 | | chr9: 80584200-80584229 | GTCAaCCTCAaC | ACCTAC | AgACTGCAAAAG |
| CCR5-224 22 | 4 | 1 | 3 | WWOX | chr16: 77185306-77185335 | GTCATCCTCcTC | CAACTC | cAAtGCtAAAG |
| CCR5-224 23 | 4 | 2 | 2 | AMBRA1 | chr11: 46422800-46422829 | GTCtTCCTCcTC | TGCACA | tcACTGCAAAAG |
| CCR5-224 24 | 4 | 2 | 2 | | chr1: 99456616-99456645 | GTgATaCTCATC | ATCAGC | AAtCTGCAtAAG |
| CCR5-224 25 | 4 | 2 | 2 | WBSCR17 | chr7: 70557254-70557283 | GTtATCCTCAgC | AAACTA | AAACTGgAAcAG |
| CCR5-224 25 | 4 | 2 | 2 | ITSN | chr21: 34098210-341398239 | cTCATgCTCATC | ATTTGT | tAACTGCAAAAt |
| CCR5-224 27 | 4 | 4 | 0 | | chr9: 106457399-106457428 | GcCAgtCTCAgC | ATGGTG | AAACTGCAAAAG |
| CCR5-224 28 | 4 | 4 | 0 | | chr17: 49929141-49929170 | cTCATtCTgtTC | ATGAAA | AAACTGCAAAAG |
| CCR5-224 29 | 5 | 3 | 2 | | chr15: 96714952-96714981 | GaagTCCTCATC | CCGAAG | AAACTGaAAgAG |
| CCR5-224 30 | 5 | 3 | 2 | ZNF462 | chr9: 108684858-108684887 | GTCtTCCTCtTt | CACATA | AAAcCGCAAAtG |
| CCR5-224 31 | 5 | 4 | 1 | | chr5: 101113644-101113673 | aTaATCCTttTC | TGTTTA | AAACaGCAAAAG |
| CCR5-224 32 | 5 | 4 | 1 | | chr17: 43908810-43908839 | GaCATCCaaATt | ACATGG | AAACTGaAAAAG |
| CCR5-224 33 | 5 | 5 | 0 | SDK1 | chr7: 3446932-3446961 | GTCtTgCTgtTg | CACCTC | AAACTGCAAAAG |
| CCR5-224 34 | 4 | 1 | 3 | SPTB(coding) | chr14: 64329872-64329901 | GTCATCCgCATC | GCCCTG | gAACTGgAAAAG |
| CCR5-224 35 | 4 | 2 | 2 | | chr10: 54268729-54268758 | aTCATCCTCAaC | AAACTA | AAACaGgAAAAG |
| CCR5-224 36 | 4 | 4 | 0 | KIAA1680 | chr4: 92322851-92322880 | GgaATgCcCATC | ACCACA | AAACTGCAAAAG |
| CCR5-224 37 | 5 | 5 | 0 | | chr5: 114708142-114708171 | GTttTgCTCcTg | TACTTC | AAACTGCAAAAG |

Table 4. Continued below; (+) half-sites SEQ ID NOs:190-226 descending; (−) half sites SEQ ID NOs:227-263 descending; full sequence with spacer descending SEQ ID NOs:264-300.

products. Indels and totals are not shown for those sites that were not tested. P-values shown are for the one-sided alternative hypothesis that the indel frequency is greater for active ZFN treated cells than for cells not expressing ZFN.

| in vitro selection stringency | | | | empty vector | | | active CCR5-224 | | | |
|---|---|---|---|---|---|---|---|---|---|---|
| 4 nM | 2 nM | 1 nM | 0.5 nM | indels | total | mutation frequency | indels | total | mutation frequency | p-value |
| X | X | X | X | 1 | 226676 | 0.00044% | 105639 | 240966 | 44% | 0 |
| X | X | X | X | 0 | 114904 | | 12856 | 130496 | 10% | 0 |
| X | X | | | 1 | 283015 | 0.00035% | 155 | 224000 | 0.070% | 0 |
| X | X | | | 2 | 297084 | 0.00067% | 3 | 245078 | 0.0012% | 0.26 |
| X | X | | | 0 | 147246 | | 0 | 136979 | | |
| X | | | X | 0 | 147157 | | 1 | 146283 | 0.00068% | 0.16 |
| X | | | | 0 | 316468 | | 0 | 313981 | | |
| X | | | | 0 | 136684 | | 0 | 94657 | | |
| X | | | | 0 | 178692 | | 52 | 146525 | 0.035% | 2.7E−13 |
| X | | | | 0 | 296730 | | 0 | 276961 | | |
| X | | | | 0 | 273436 | | 1045 | 308726 | 0.34% | 0 |
| X | | | | | | | | | | |
| X | | | | 0 | 168244 | | 1 | 171618 | 0.00058% | 0.16 |
| X | | | | 0 | 66317 | | 35 | 138728 | 0.025% | 1.6E−09 |
| X | | | | 1 | 427161 | 0.00023% | 280 | 393899 | 0.071% | 0 |
| X | | | | 0 | 190993 | | 32 | 171160 | 0.019% | 7.7E−09 |
| X | | | | 0 | 163704 | | 0 | 146176 | | |
| X | | | | 0 | 109939 | | 0 | 100948 | | |
| X | | | | | | | | | | |
| X | | | | 0 | 114743 | | 0 | 120169 | | |
| X | | | | 0 | 188149 | | 127 | 213248 | 0.060% | 0 |
| X | | | | 0 | 366156 | | 0 | 354878 | | |
| X | | | | 0 | 237240 | | 0 | 227568 | | |
| X | | | | 0 | 129468 | | 0 | 144274 | | |
| X | | | | 0 | 172543 | | 486 | 417198 | 0.12% | 0 |
| X | | | | 0 | 267772 | | 0 | 308093 | | |
| X | | | | 0 | 350592 | | 0 | 335281 | | |
| X | | | | 0 | 105012 | | 0 | 99968 | | |
| X | | | | 0 | 355674 | | 0 | 338910 | | |
| X | | | | 0 | 173646 | | 1 | 152744 | 0.00065% | 0.16 |
| X | | | | 1 | 245650 | 0.00041% | 0 | 185572 | | 0.84 |
| X | | | | 0 | 482635 | | 2 | 413317 | 0.00048% | 0.079 |
| X | | | | 0 | 237791 | | 0 | 200398 | | |
| | X | | | 0 | 180783 | | 0 | 167885 | | |
| | X | | | | | | | | | |
| | X | | | 0 | 165657 | | 2 | 153995 | 0.0013% | 0.079 |
| | X | | | 0 | 152083 | | 0 | 183305 | | |

Table 5. Potential CCR5-224 genomic off-target sites. The human genome was searched for DNA sequences surviving in vitro selection for CCR5-224 cleavage. Sites marked with an 'X' were found in the in vitro selection dataset. 'T' refers to the total number of mutations in the site, and '(+)' and '(−)' to the number of mutations in the (+) and (−) half-sites, respectively. Chromosomal coordinates from build 36 of the human genome are listed. Mutation frequency for each site is the percentage of sequences with insertions or deletions (indels) in the sequenced DNA from cultured K562 cells expressing active CCR5-224. Bolded red sites have significantly enriched indel percentages in the active nuclease sample compared to cells containing empty vector. The sequences of the sites are listed as 5' (+) halfsite/spacer/(−) half-site 3', therefore the (+) half-site is listed in the reverse sense as it is in the sequence profiles. Three sites were not tested since they did not yield site-specific PCR amplification

| CCR5-224 | | VF2468 | |
|---|---|---|---|
| # of mutations | # of sites in genome | # of mutations | # of sites in genome |
| 0 | 1 | 0 | 1 |
| 1 | 0 | 1 | 3 |
| 2 | 1 | 2 | 245 |
| 3 | 6 | 3 | 3,201 |
| 4 | 99 | 4 | 35,995 |
| 5 | 964 | 5 | 316,213 |
| 6 | 9,671 | 6 | 2,025,878 |
| 7 | 65,449 | | |
| 8 | 372,801 | | |
| 9 | 1,854,317 | | |

Table 6: There are many more potential genomic VF2468 target sites than CCR5-224 target sites. The human genome was computationally searched for sites up to nine mutations away from the canonical CCR5-224 target site and up to six mutations away from the canonical VF2468 target site. The number of occurrences of sites containing five or six base pair spacers in the genome, including repeated sequences, is listed in the table.

|  | # of sequences |
|---|---|
| BTBD10 (promoter) | |
| ATTTTGCAGTTT GCTTT GATGAGGAAAAC | |
| ATTTTGCAGTTT GCTTT GATGAGGAAAAC | 63 |
| ATTTTGCAGTTT GCTTTGCTTT GATGAGGAAAAC | 86 |
| ATTTTGCAGTTT GgTTTGCTTT GATGAGGAAAAC | 1 |
| ATTTTGCAGTTT GCTTTGGTTT GgTGAGGAAAAC | 1 |
| gTTTTGCAGTTT GCTTTGCTTT GATGAGGAAAAC | 1 |
| cTTTTGCAGgTT GCTTTGCTTT GATGAGGAAAAC | 1 |
| ATTTTGCAGTTT GCTTTGCTTT GATGtGGAAAAC | 1 |
| ATTTTGCAGTTT GCTTT GATGAGGAAAAC | 1 |
| chr17: 61624429-61624457 | |
| GTTTTGCAGTTC CTTTT GATGAAGATGAC | |
| GTTTTGCAGTTC CTTTT GATGAAGATGAC | 51 |
| GTTTTGGAGgTC CTTTT GATGAAGATGAC | 1 |
| TACR3 | |
| ACTTTACAGTTT ATGCT GATGAAGATGAC | |
| AGTTTACAGTTT ATGCT GATGAAGATGAC | 5 |
| ACTTTAGAGTTT ATGCT GATGAAGATGAC | 169 |
| gCTTTACAGTTT ATGCT GATGAAGATGAC | 1 |
| ACTTTACAGTTT ATGCT GATGAAGAatAC | 1 |
| ACTTTACAGTTT ATGCT GATGAAGATGtt | 1 |
| ACTTTACAGTTT ATGCT GATGAAGATGAC | 34 |
| ACTTTACgGTTT ATGCT GATGAAGATGAC | 1 |
| ACTTTACAGTTT ATGCT GATGAAGATGAC | 180 |
| ACTTTACAGTTT ATGCT GATGAAGATGcC | 1 |
| ACTTTACAGTTT ATGCTATGCT GATGAAGATGAC | 507 |
| gCTTTACAGTTT ATGCTATGCT GATGAAGATGAC | 1 |
| ACTTTACgGTTT ATGCTATGCT GATGAAGATGAC | 1 |
| ACTTTACAGTTT ATGCTATGCT GATGAtGATGAC | 1 |
| ACgTTACAGTTT ATGCTATGCT GATGAAGATGAC | 1 |
| ACTTTACAGTTT ATGCT GATGAAGATGAC | 140 |
| ACTTTACAGTTT ATGCT GATGAAGATGtC | 1 |
| WBSCR17 | |
| GTTATCCTCAGC AAACTA AAACTGGAACAG | |
| GTTATCCTCAGC AAACTAACTA AAACTGGAACAG | 128 |
| GTTATCCTCAGC AAACTA AAACTGGAACAG | 118 |
| GTTATCCTCAGC AAACTA AAACTGGgACAG | 1 |
| GTTATCCTCAGC AAACTA AAACTGGAcCAG | 1 |
| GTTATaCTCAGC AAACTA AAACTGGAACAG | 1 |
| GTTATCCTCAGC AAACTA AAAGTGGAACAG | 116 |
| aTTATCCTCAGC AAACTA AAACTGGAACAG | 1 |

|  | # of sequences |
|---|---|
| GTTATCCTtAGC AAACTA AAACTGGAACAG | 1 |
| GTTATCCTCAGC AAACTA AAACTGGAACAG | 118 |
| GaTATCCTCAGC AAACTA AAACTGGAACAG | 1 |
| chr6: 52114315-52114343 | |
| CTTTTTCAGTTT CTTTT GCTGAGCAGGAC | |
| CTTTTTCAGTTT CTTTT GCTGAGCAGGAC | 35 |
| KCNB2 | |
| CATTTGCAGTTT CGGGA GATGAGGAACAT | |
| CATTTGGAGTTT CGGGAGA GATGAGGAACAT | 15a |
| CATTTGCAGTTa CGGGAGA GATGAGGAACAT | 1 |
| CATTTGGAGTTT CGGGAGA GATGAGGgACAT | 1 |
| CATTTGacGcTT CGGGAGA GgTGAGGgACAT | 1 |
| CATTTGGAGTTT CGGGCGGGA GATGAGGAACAT | 109 |
| CATTTGCAGTTT CGGGCGGGA GATGcGGAACAT | 1 |
| CATTTGGAGTTT CGGGCGGGc GATGAGGAACAT | 1 |
| CATTTGCAGTTT CGGGCGGGA GgTGAGGAACAT | 1 |
| CgTTTGCAGTTT CGGGCGGGA GATGAGGAACAT | 2 |
| CATTTGCtGTTT CGGGCGGGA GATGAGGAACAT | 1 |
| CATTTGCAGTTT CGGGCGGGA GATGAGGAcCAT | 1 |
| CATTTGGAGTTT CGGGCGGGA GgTGAGGAAGAT | 1 |
| CcTTTGCAGTTT CGGGCGGGA GATGAGGAACAT | 1 |
| CATTTGCAGTTg CGGGCGGGA GATGAGGAACAT | 1 |
| chr8: 4865886-4865914 | |
| GTCTTCCTGATG CTACC AAACTGGAAAAG | |
| GTCTTCCTGATG CTACC AAACTGGAAAAG | 30 |
| GTCTTCCTGATG CTACC AAACTtGAAAAG | 1 |
| GTCTTCaTGATG CTACC AAACTGGAAAAG | 1 |
| chr9: 80584200-80584229 | |
| CTTTTGCAGTCT GTAGGT GTTGAGGTTGAC | |
| CTTTTGCAGTCT GTAGGT GTTGAGGTTGAC | 125 |
| CTTTTGCAGTCT GTAGGT GTTGAGGTTGAC | 1 |
| CTTTTGGAGICT GTAGGT GTTGAGGTTGAC | 1 |

Table 7: Sequences of CCR5-224-mediated genomic DNA modifications identified in cultured human K562 cells (SEQ ID NOs:301-365, descending, then left to right). Sequences with insertions (blue) and deletions (red) identified after sequencing potential CCR5-224 off-target sites from cultured K562 cells expressing CCR5-224 are shown. The numbers of occurrences are shown to the right of each sequence. Other mutations are indicated with lowercase letters and likely reflect mutations that arose during PCR or sequencing. The unmodified site is listed under the gene name or coordinates (build 36), and the spacer sequence is underlined.

| | muta-tions | | | | build 36 coordinates | (+) half-site | spacer | (−) half-site | In vitro selection frequency | | | | empty vector | | | active VF2468 | | | |
|---|---|---|---|---|---|---|---|---|---|---|---|---|---|---|---|---|---|---|---|
| | T | (+) | (−) | gene | | | | | 4 nM | 2 nM | 1 nM | 0.5 nM | indels | total | mutation frequency | indels | total | mutation frequency | p-value |
| VF2468 1 | 0 | 0 | 0 | VEGF-a (promoter) | chr8:43,846,383-43,845,415 | AGCAGCGTC | TTCGA | GAGTGAGGA | X | X | X | X | 125 | 147187 | 0.086% | 27067 | 188786 | 1.4% | 0 |
| VF2468 2 | 1 | 1 | 0 | | chr1:168,832,550-168,832,672 | AGCAGCGTC | AATAC | GAGTGAaGA | X | X | X | X | ☐ | 57855 | | 1 | 62196 | 0.0016% | 0.16 |
| VF2468 3 | 1 | 1 | 0 | | chr1:242,574,122-242,574,144 | AGCAGCctC | TGCTT | GAGTGAGGA | X | X | X | X | ☐ | 167447 | | 0 | 147340 | 0 | 0 |
| VF2468 4 | 1 | 1 | 0 | ZNF683 | chr1:26,989,668-26,569,690 | AGCAGCGTt | GGGAG | GAGTGAGGA | X | X | X | X | ☐ | 111340 | | 0 | 109365 | 0 | 0 |
| VF2468 5 | 2 | 0 | 2 | GSG1L | chr16:27,853,984-27,854,006 | AGCAGCGTC | AAAAA | cAGTGAGcA | X | X | X | X | ☐ | 80047 | | 0 | 69080 | 0 | 0 |
| VF2468 6 | 2 | 0 | 2 | C5orF98 | chr9:134,636,934-134,636,956 | AGCAGCGTC | GTGTG | GtGTGAGGt | X | X | X | X | | | | | | | |
| VF2468 7 | 2 | 0 | 2 | EFHD1 | chr2:233,205,384-233,205,477 | AGCAGCGTC | GTTCTC | cAGTGgGGA | X | X | X | X | ☐ | 202694 | | 0 | 204809 | 0 | 0 |
| VF2468 8 | 2 | 0 | 2 | | chr20:30,234,845-30,234,968 | AGCAGCGTC | TAGCA | GAGgGAaGA | X | X | X | X | ☐ | 160769 | | 1 | 158886 | 0.00063% | 0.16 |
| VF2468 9 | 2 | 0 | 2 | KIAA0841 (exon-intron) | chr18:40,800,787-40,800,820 | AGCAGCGTC | TAGGGG | GAcgGAGGG | X | X | X | X | 1 | 81184 | 0.0012% | 446 | 79138 | 0.58% | 0 |
| VF2468 10 | 2 | 0 | 2 | CE37 | chr16:54,501,918-54,501,941 | AGCAGCGTC | TCAAAA | GAGTGtGcA | X | X | X | X | 1 | 168501 | 0.00059% | 0 | 144701 | 0 | 0.84 |
| VF2468 11 | 2 | 0 | 2 | PTK2B | chr8:27,338,866-27,229,978 | AGCAGCGTC | TCCCTT | GAGTGAtCg | X | X | X | X | 0 | 178602 | | 58 | 138849 | 0.040% | 3.8E-14 |
| VF2468 12 | 2 | 0 | 2 | | chr8:137,316,488-137,316,621 | AGCAGCGTC | TGAAA | GAGTGAaaA | X | X | X | X | 0 | 286630 | | 186 | 254714 | 0.086% | 0 |
| VF2468 13 | 2 | 1 | 1 | | chr20:7,985,471-7,985,493 | AGCAGCGTC | ATCGA | GAGTGAGGt | X | X | X | X | ☐ | 166914 | | 0 | 148547 | 0 | 0 |
| VF2468 14 | 2 | 1 | 1 | | chrY:8,461,018-8,461,041 | AGCaGCGTC | AGATAG | GgGTGAGGG | X | X | X | X | | | | | | | |
| VF2468 15 | 2 | 1 | 1 | | chr1:63,720,888-63,720,480 | AGCaGCGTC | ATATT | cAGTGAGGA | X | X | X | X | 0 | 328680 | | 146 | 290700 | 0.060% | 0 |

-continued

| | muta-tions T (+) (-) | gene | build 36 coordinates | (+) half-site | spacer | (-) half-site | In vitro selection frequency 4nM 2nM 1nM 0.5nM | empty vector indels | total | mutation frequency | active VF2468 indels | total | mutation frequency | p-value |
|---|---|---|---|---|---|---|---|---|---|---|---|---|---|---|
| VF2468 16 | 2 1 1 | | chrX:122,132,519-122,132,541 | AGCAGCGTC | GTAGT | GAtTGAGGA | X X X X | □ | 157651 | | 0 | 136373 | 0 | |
| VF2468 17 | 2 1 1 | F4HA1 | chr10:74,506,346-74,506,368 | AGCAcCGTC | TTTTC | tAGTGAGGA | X X X X | | | | | | | |
| VF2468 18 | 2 1 1 | DFKZp488L07201 | chrX:58,830,910-68,830,833 | AGCAGaGTC | AGACTT | GAGTGAGGt | X X X X | 0 | 13880 | | 13 | 12338 | 0.10% | 0.00016 |
| VF2468 19 | 2 1 1 | TTC4 | chr1:64,881,886-64,831,917 | AGCAGaGTC | TCTGA | GAGTGAGGc | X X X X | 0 | 176808 | | 183 | 191327 | 0.086% | 0 |
| VF2468 20 | 2 1 1 | | chr1:175,647,668-175,647,690 | AGCAGCaTC | AGTGA | GAGTGAGGc | X X X X | 1 | 286818 | 0.00035% | 3 | 343497 | 0.00087% | 0.20 |
| VF2468 21 | 2 1 1 | | chr1:50,490,333-50,490,356 | GAGTGAGGc | TCCAAA | GAGTGAGGc | X X X X | □ | 168032 | | 0 | 183289 | 0 | |
| VF2468 22 | 2 1 1 | | chr4:128,244,847-128,244,870 | AGCAGCcTC | TGCATC | GAGTGAGGt | X X X X | □ | 86347 | | 0 | 87663 | 0 | |
| VF2468 23 | 2 1 1 | | chr13:27,399,187-27,399,210 | AGCAGCGaC | GCCTGG | GAGTGAGGt | X X X X | 0 | 23198 | | 384 | 34466 | 1.1% | 0 |
| VF2468 24 | 2 1 1 | | chr18:82,803,202-82,803,328 | AGCAGCGTa | TCACAT | GAGTGAGGg | X X X X | 0 | 57001 | | 283 | 83341 | 0.44% | 0 |
| VF2468 25 | 2 1 1 | | chr11:69,063,501-69,063,523 | AGCAGCGTg | CCCAA | GAGTGAGGc | X X X X | □ | 181022 | | 0 | 221989 | 0 | |
| VF2468 26 | 2 1 1 | TNR | chr1:173,885,442-172,885,465 | AGCAGCtTC | AGGGGA | GtGTGAGGA | X X X X | □ | 132693 | | 0 | 139071 | 0 | |
| VF2468 27 | 2 1 1 | PTPRM | chr18:8,320,310-6,320,332 | AGCAGCtTC | CTTTT | GAGTGAGGA | X X X X | □ | 73084 | | 0 | 100249 | 0 | |
| VF2468 28 | 2 1 1 | | chr12:26,724,684-26,724,688 | AGCAGCtTC | TCCTTGG | GAGTGAGGg | X X X X | 0 | 323231 | | 1116 | 353441 | 0.32% | 0 |
| VF2468 29 | 2 1 1 | | chr13:82,039,140-82,039,183 | AGCAGgGTC | AGGGCT | GAGTGAGGc | X X X X | 0 | 168241 | | 439 | 188937 | 0.28% | 0 |
| VF2468 30 | 2 1 1 | | chr3:131,201,886-131,201,818 | AGCAGtGTC | AGGCTG | GtGTGAGGA | X X X X | 0 | 77427 | | 1980 | 82791 | 2.1% | 0 |

-continued

| | muta-tions T (+) (−) | gene | build 36 coordinates | (+) half-site | spacer | (−) half-site | In vitro selection frequency 4 nM | 2 nM | 1 nM | 0.5 nM | empty vector indels | total | mutation frequency | active VF2468 indels | total | mutation frequency | p-value |
|---|---|---|---|---|---|---|---|---|---|---|---|---|---|---|---|---|---|
| VF2468 31 | 2 1 1 | | chr3:76,708,387-76,709,410 | AGCAgtGTC | AGGCTG | GtGTGAGGA | X | X | X | X | 0 | 34408 | | 114 | 33070 | 0.34% | 0 |
| VF2468 32 | 2 1 1 | | chr11:3,668,299-3,668,322 | AGCAgtGTC | AGGCTG | GtGTGAGGA | X | X | X | X | 0 | 19830 | | 19 | 17408 | 0.11% | 8.6E-08 |
| VF2468 33 | 2 1 1 | | chr3:128,870,762-128,870,786 | AGCAgtGTC | AGGCTG | GtGTGAGGA | X | X | X | X | 0 | 89879 | | 2570 | 90901 | 2.8% | 0 |
| VF2468 34 | 2 1 1 | | chr11:71,030,884-71,030,907 | AGCAgtGTC | AGGCTG | GtGTGAGGA | X | X | X | X | 0 | 112449 | | 231 | 150276 | 0.16% | 0 |
| VF2468 35 | 2 1 1 | 8BF2/U80788 | chr11:8,884,211-8,884,234 | AGCAgtGTC | CTAAGG | GgGTGAGGA | X | X | X | X | 0 | 418083 | | 885 | 532186 | 0.13% | 0 |
| VF2468 36 | 2 1 0 | KRI1 (coding) | chr19:10,534,492-10,534,515 | AGCAtCGTC | ATCAGA | cAGTGAGGA | X | X | X | X | | 141739 | | 0 | 1393668 | | |
| VF2468 37 | 2 1 0 | | chr8:112,421,478-112,421,498 | AGCAtCGTC | TGAAGT | GAGTGAGGA | X | X | X | X | 0 | 153887 | | 1174 | 178569 | 0.88% | 0 |
| VF2468 38 | 2 1 0 | MICAL3/KIAA1384 | chr22:18,713,914-18,713,837 | AGCAtCGTC | TTCTGT | GAGTGAGtA | X | X | X | X | 0 | 287706 | | 176 | 283796 | 0.82% | 0 |
| VF2468 39 | 2 1 0 | MUC16 (exon-intron) | chr19:8,894,218-8,894,241 | AGgAGCGTC | TCACCT | GAGTGAGGc | X | X | X | X | | 212038 | | 0 | 219913 | | |
| VF2468 40 | 2 2 0 | | chr8:6,638,000-6,628,023 | AaCAGcTTC | ATCTCG | GAGTGAGGA | X | X | X | X | | 132803 | | 0 | 147070 | | |
| VF2468 41 | 2 2 0 | PREX1 | chr20:46,733,644-36,733,667 | AaCAGcTTC | TCGGGA | GAGTGAGGA | X | X | X | X | | 204408 | | 0 | 227091 | | |
| VF2468 42 | 2 2 0 | CDH20 | chr18:57,303,454-57,303,477 | AaCAGcTTC | TCTGAG | GAGTGAGGA | X | X | X | X | 1 | 313747 | 0.00032% | 1 | 403382 | 0.00025% | 0.57 |
| VF2468 43 | 2 2 0 | | chr20:6,213,500-6,213,522 | AGCAaaGTC | AAACA | GAGTGAGGA | X | X | X | X | 1 | 154154 | 0.00065% | 0 | 183644 | | 0.84 |
| VF2468 44 | 2 2 0 | | chr5:85,841,208-65,841,331 | AGCAGcGTC | TGGAA | GAGTGAGGA | X | X | X | X | | | | | | | |
| VF2468 45 | 2 2 0 | | chr8:20,481,270-20,481,292 | AGCAaCTTC | AATTG | GAGTGAGGA | X | X | X | X | | 250890 | | 0 | 297104 | | |

-continued

| | muta-tions | | | | | (+) half-site | spacer | (-) half-site | In vitro selection frequency | | | | empty vector | | | active VF2468 | | |
|---|---|---|---|---|---|---|---|---|---|---|---|---|---|---|---|---|---|---|
| | T | (+) | (-) | gene | build 36 coordinates | | | | 4 nM | 2 nM | 1 nM | 0.5 nM | indels total | mutation frequency | | indels total | mutation frequency | p-value |
| VF2468 46 | 2 | 2 | 0 | | chr5:95,417,045-96,417,068 | AGCAcCaTC | ATAGCA | GAGTGAGGA | X | X | X | X | ☐ | 274402 | | 1 | 319493 | 0.00031% | |
| VF2468 47 | 2 | 2 | 0 | RCRA | chr15:59,165,302-59,165,325 | AGCAGCaTa | GATATG | GAGTGAGGA | X | X | X | X | ☐ | 270263 | | 1 | 358704 | 0.00028% | 0.16 |
| VF2468 48 | 2 | 2 | 0 | | chr6:24,504,489-24,504,511 | AGCAGCaTa | TCAGG | GAGTGAGGA | X | X | X | X | ☐ | 103878 | | 0 | 176333 | | |
| VF2468 49 | 2 | 2 | 0 | | chr3:31,085,287-31,085,309 | AGCAGCGag | AAAGA | GAGTGAGGA | X | X | X | X | ☐ | 542052 | | 0 | 708517 | | |
| VF2468 50 | 2 | 2 | 0 | | chr6:27,579,690-27,579,712 | AGCAGCGgt | CTTAG | GAGTGAGGA | X | X | X | X | ☐ | 177732 | | 1 | 212250 | 0.00047% | 0.16 |
| VF2468 51 | 2 | 2 | 0 | | chr12:113,410,592-113,410,615 | AGCAGgGTt | CTTCAA | GAGTGAGGA | X | X | X | X | ☐ | 294783 | | 0 | 302167 | | |
| VF2468 52 | 2 | 2 | 0 | | chr11:11,399,534-11,399,556 | AGCtGaGTC | CTAAA | GAGTGAGGA | X | X | X | X | ☐ | 482765 | | 1 | 402831 | 0.00025% | 0.16 |
| VF2468 53 | 2 | 2 | 0 | MCTP1 | chr5:94,590,016-94,590,038 | AGCtGaGTC | TTAAG | GAGTGAGGA | X | X | X | X | ☐ | 183510 | | 1 | 202083 | 0.00049% | 0.16 |
| VF2468 54 | 2 | 2 | 0 | | chr1:13,394,902-13,394,924 | AGCtGgGTC | ATGAG | GAGTGAGGA | X | X | X | X | ☐ | 88944 | | 0 | 105879 | | |
| VF2468 55 | 2 | 2 | 0 | PRAMEF20 | chr1:13,615,741-13,615,763 | AGCtGgGTC | ATGAG | GAGTGAGGA | X | X | X | X | | | | | | | |
| VF2468 56 | 2 | 2 | 0 | | chr20:59,154,784-59,154,806 | AGCtGtGTC | CACAG | GAGTGAGGA | X | X | X | X | ☐ | 360710 | | 0 | 351215 | | |
| VF2468 57 | 2 | 2 | 0 | | chr14:100,903,675-100,903,697 | AGCtGtGTC | TTGGA | GAGTGAGGA | X | X | X | X | ☐ | 140671 | | 0 | 157922 | | |
| VF2468 58 | 2 | 2 | 0 | | chrX:141,701,170-141,701,192 | AGtAGcGgC | AAATT | GAGTGAGGA | X | X | X | X | ☐ | 196624 | | 0 | 209781 | | |
| VF2468 59 | 2 | 2 | 0 | GTF3C1 | chr16:27,452,953-27,452,975 | AGtgGCGTC | CCAGT | GAGTGAGGA | X | X | X | X | ☐ | 223714 | | 0 | 246196 | | |
| VF2468 60 | 2 | 2 | 0 | DNMBP/AKD89111 | chr10:101,688,961-101,688,983 | gGcAGaGTC | CTAGA | GAGTGAGGA | X | X | X | X | ☐ | 302495 | | 0 | 383303 | | |

-continued

| muta-tions T (+) (-) | gene | build 36 coordinates | (+) half-site | spacer | (-) half-site | In vitro selection frequency 4nM 2nM 1nM 0.5nM | empty vector indels | empty vector total | empty vector mutation frequency | active VF2468 indels | active VF2468 total | active VF2468 mutation frequency | p-value |
|---|---|---|---|---|---|---|---|---|---|---|---|---|---|
| VF2468 61  3  2  0 |  | chr6:137,852,455-137,852,478 | tcCAGCGTC | CTCCCA | GAGTGAGGA | X X X X | □ | 84153 |  | 0 | 113996 |  |  |
| VF2468 62  3  2  0 | 3ARDH | chr9:136,682,239-136,692,282 | tGCAGCGgC | GTAGGG | GAGTGAGGA | X X X X |  | 191187 |  | 138 | 212086 | 0.086% | 0 |
| VF2468 63  3  2  0 |  | chr7:19,683,400-19,683,423 | tGCAGCGTt | AAAATA | GAGTGAGGA | X X X X | 1 | 372808 | 0.00027% | 2 | 438355 | 0.00046% | 0.33 |
| VF2468 64  3  2  0 | ZNF62B | chr19:60,683,246-60,683,269 | tGCAGgGTC | GGGCAG | GAGTGAGGA | X X X X | □ | 167551 |  | 0 | 185442 |  |  |
| VF2468 65  3  2  0 |  | chr3:130,430,426-130,430,448 | tGCAgtGTC | CACAA | GAGTGAGGA | X X X X |  |  |  |  |  |  |  |
| VF2468 66  3  1  2 | GBF1 | chr10:104,073,889-104,074,012 | AGCAaCGTC | CATAGT | GtGTGAGaA | X X X X | 4 | 646643 | 0.00073% | 3768 | 687393 | 0.84% | 0 |
| VF2468 67  3  1  2 |  | chr14:96,561,728-96,561,751 | AGCAaCGTC | TAACCC | GAGTGttGA | X X X X | □ | 171147 |  | 0 | 203860 |  |  |
| VF2468 68  3  1  2 | PDE9A | chr21:42,882,083-42,932,106 | AGCAcCGTC | CCCCT | cAGTGAGGc | X X X X | 0 | 88878 |  | 381 | 137234 | 0.28% | 0 |
| VF2468 69  3  1  2 | MTX2 | chr2:178,842,448-176,842,470 | AGCAGCGgC | GGCTG | cAGTGAGGc | X X X X | 0 | 38342 |  | 153 | 60273 | 0.30% | 0 |
| VF2468 70  3  1  2 |  | chr6:104,071,040-104,071,063 | AGCAGCCgC | TTAAGG | GgGTGAGGt | X X X X | □ | 252020 |  | 0 | 277262 |  |  |
| VF2468 71  3  1  2 |  | chr3:32,220,862-32,220,885 | AGCAgtGTC | TAAAAG | GAGTGAGat | X X X X | □ | 178243 |  | 0 | 225921 |  |  |
| VF2468 72  3  1  1 |  | chr2:11,428,186-11,428,218 | AGaAaCGTC | GTGGAG | GAGTGAGGg | X X X X | 0 | 138844 |  | 84 | 221878 | 0.042% | 0 |
| VF2468 73  3  1  1 | OPH6 | chr8:47,881,416-47,891,438 | AGCAaaGTC | TGTACT | GAGTGAGGg | X X X X | 0 | 182686 |  | 2808 | 212729 | 1.3% | 0 |
| VF2468 74  3  1  1 |  | chr2:195,362,417-195,362,439 | AGCAaCaTC | ATCTT | GAGTGAGGg | X X X X | □ | 103739 |  | 1 | 130605 | 0.00077% | 0.16 |
| VF2468 75  3  1  1 | MPOL1 | chr14:36,952,701-36,952,724 | AGCAaCaTC | TGGTG | GAGTGAGGg | X X X X | 1 | 300572 | 0.00033% | 0 | 355283 |  | 0.84 |

-continued

| | muta-tions | | | build 36 coordinates | (+) half-site | spacer | (−) half-site | In vitro selection frequency | | | | empty vector | | | active VF2468 | | |
|---|---|---|---|---|---|---|---|---|---|---|---|---|---|---|---|---|---|
| T | (+) | (−) | gene | | | | | 4 nM | 2 nM | 1 nM | 0.5 nM | indels | total | mutation frequency | indels | total | mutation frequency | p-value |
| VF2468 76 | 3 | 2 | 1 | | chr4:138,603,959-138,603,981 | AGCAaCtTC | ATCTT | GAGTGAGg | X | X | X | X | ☐ | 185773 | | 0 | 185094 | |
| VF2468 77 | 3 | 2 | 1 | LRCH1 | chr13:46,079,921-46,079,943 | ATCAaCtTC | CTGGC | GAGTGAGg | X | X | X | X | 1 | 131239 | 0.00076% | 0 | 133319 | 0.84 |
| VF2468 78 | 3 | 2 | 1 | KIAA0888 | chr11:116,282,384-116,282,408 | AGCAatGTC | AAAA | GAGTGAGc | X | X | X | X | 0 | 212883 | | 243 | 167434 | 0.16% 0 |
| VF2468 79 | 3 | 2 | 1 | | chr12:13,363,829-13,363,861 | AGCAcCGTg | GCTTC | GAGTGAGc | X | X | X | X | 0 | 112164 | | 34 | 118886 | 0.029% 2.7E-09 |
| VF2468 80 | 3 | 2 | 1 | PLMXMA4 (coding) | chr7:131,503,708-131,603,730 | AGCAcgGTC | ATGAT | GAGTGAGc | X | X | X | X | 0 | 186677 | | 77 | 188336 | 0.041% 0 |
| VF2468 81 | 3 | 2 | 1 | TSPEAR | chr21:44,817,259-44,817,282 | AGCAGCggc | CCACAG | GAGTGAGg | X | X | X | X | 1 | 151845 | 0.00066% | 0 | 144107 | 0.84 |
| VF2468 82 | 3 | 2 | 1 | | chr18:74,634,790-74,634,812 | AGCAGCagC | TAGGG | GAGTGAGg | X | X | X | X | | | | | | |
| VF2468 83 | 3 | 2 | 1 | | chr10:33,904,306-33,9-4,328 | AGCAGCtcC | TCTCC | GAGTGAGt | X | X | X | X | ☐ | 240952 | | 1 | 233954 | 0.00043% 0.16 |
| VF2468 84 | 3 | 2 | 1 | | chr6:170,226,156-170,226,178 | AGCAGgGTg | GCGTG | GAGTGAGc | X | X | X | X | ☐ | 191108 | | 0 | 167663 | |
| VF2468 85 | 3 | 2 | 1 | | chr3:118,684,878-118,684,901 | AGCAtaGTC | TAGGCC | GAGTGAGc | X | X | X | X | 0 | 406843 | | 209 | 366897 | 0.068% 0 |
| VF2468 86 | 3 | 2 | 1 | HRA3L3 | chr3:194,462,126-184,462,147 | AGCAtgGTC | CAAG | GAGTGAGg | X | X | X | X | 0 | 212842 | | 383 | 247078 | 0.18% 0 |
| VF2468 87 | 3 | 2 | 1 | | chr17:18,434,608-19,434,531 | AGCAttGTC | TCATGT | GAGTGAGt | X | X | X | X | 0 | 4171 | | 18 | 3024 | 0.60% 1.0E-06 |
| VF2468 88 | 3 | 2 | 1 | | chr8:126,882,679-126,932,801 | AGCAttGTC | TCCTG | GAGTGAGg | X | X | X | X | 0 | 116887 | | 58 | 116268 | 0.061% 7.8E-16 |
| VF2468 89 | 3 | 2 | 1 | UHRF1BP1L | chr12:99,011,715-99,011,737 | AGtAGCGTt | TTTAG | GAGTGAGt | X | X | X | X | 1 | 171873 | 0.00058% | 0 | 207336 | 0.84 |
| VF2468 90 | 3 | 2 | 1 | | chr14:762,405-14,762,427 | AtCAGaGTC | TCTGG | GAGTGAGc | X | X | X | X | 2 | 193447 | 0.0010% | 1 | 196665 | 0.00051% 0.72 |

-continued

| | muta-tions | | | | build 36 coordinates | (+) half-site | spacer | (−) half-site | In vitro selection frequency | | | | empty vector | | | active VF2468 | | |
|---|---|---|---|---|---|---|---|---|---|---|---|---|---|---|---|---|---|---|
| | T | (+) | (−) | gene | | | | | 4 nM | 2 nM | 1 nM | 0.5 nM | indels | total | mutation frequency | indels | total | mutation frequency p-value |
| VF2468 91 | 3 | 2 | 1 | LAMB3 (promoter) | chr1:207,894,357-207,894,382 | AtCAGtGTC | CCTCAG | GAGTGAGGc | X | X | X | X | ☐ | 107549 | | 0 | 109933 | |
| VF2468 92 | 3 | 2 | 1 | BRUNOL4 | chr18:33,160,009-33,160,032 | gGCAGaGTC | AGGGCT | GAGTGAGGc | X | X | X | X | ☐ | 71298 | | 0 | 77229 | |
| VF2468 93 | 3 | 2 | 1 | | chr16:84,004,297-84,004,320 | gGCAGCGgC | CGCTGT | GAGTGAGGt | X | X | X | X | ☐ | 99279 | | 0 | 121284 | |
| VF2468 94 | 3 | 2 | 1 | DFKZp586E1619/ BRD1 | chr22:48,558,064-48,558,086 | tGCAGCtTC | ATGGT | GAGTGAGGc | X | X | X | X | ☐ | 152551 | | 0 | 206428 | |
| VF2468 95 | 3 | 3 | 0 | | chr7:22,054,784-22,054,907 | AGCAtaGTt | ACCTGG | GAGTGAGGA | X | X | X | X | ☐ | 91338 | | 0 | 134004 | |
| VF2468 96 | 3 | 3 | 0 | | chr14:25,876,126-25,876,149 | AGtAaaGTC | TAAGTA | GAGTGAGGA | X | X | X | X | ☐ | 245402 | | 0 | 345728 | |
| VF2468 97 | 4 | 3 | 1 | CNNM2 | chr10:104,716,593-104,716,615 | tGCAGctTC | CTTGG | GAGTGAGGt | X | X | X | X | ☐ | 76762 | | 0 | 92742 | |

Table 8: Potential VF2468 genomic off-target sites. DNA for 90 out of 97 potential VF2468 genomic target sites were amplified by PCR from cultured K562 cells expressing active VF2468 ZFN or from cells containing empty expression vector (SEQ ID NOs: 366-653). Mutation frequency for each site is the percentage of sequences with insertions or deletions (indels) in the sequenced DNA from cultured K562 cells expressing active VF2468. Bolded red sites have significantly enriched indel percentages in the active nuclease sample compared to cells not expressing nuclease. The sequences of the sites are listed as 5' (+) halfsite (SEQ ID NOs: 366-461)/spacer/(−) half-site 3' (SEQ ID NOs:462-557) (Full sequences are SEQ ID NOs: 558-653), therefore the (+) half-site is listed in the reverse sense as it is in the sequence profiles. Seven sites were not tested since they did not yield site-specific PCR amplification products. Indels and totals are not shown for those sites that were not tested. P-values shown are for the one-sided alternative hypothesis that the indel frequency is greater for active ZFN treated cells than for cells not expressing ZFN.

| oligonucleotide name | oligonucleotide sequence (5'→3') |
| --- | --- |
| N5-PvuI | NNNNNCGATCGTTGGGAACCGGA |
| CCR5-224-N4 | NG*T*C*A*T*C*C*T*C*A*T*C*NNNNA*A*A*C*T*G*C*A*A*A*A*G*NCAGTGGAACGAA |
| CCR5-224-N5 | NG*T*C*A*T*C*C*T*C*A*T*C*NNNNNA*A*A*C*T*G*C*A*A*A*A*G*NCAGTGGAACGAAAACTCACG |
| CCR5-224-N6 | NG*T*C*A*T*C*C*T*C*A*T*C*NNNNNNA*A*A*C*T*G*C*A*A*A*A*G*NCAGTGGAACGAAAACTCACG |
| CCR5-224-N7 | NG*T*C*A*T*C*C*T*C*A*T*C*NNNNNNNA*A*A*C*T*G*C*A*A*A*A*G*NCAGTGGAACGAAAACTCACG |
| VF2468-N4 | NA*G*C*A*G*C*G*T*C*NNNNG*A*G*T*G*A*G*G*A*NCAGTGGAACGAAAACTCACG |
| VF2468-N5 | NA*G*C*A*G*C*G*T*C*NNNNNG*A*G*T*G*A*G*G*A*NCAGTGGAACGAAAACTCACG |
| VF2468-N6 | NA*G*C*A*G*C*G*T*C*NNNNNNG*A*G*T*G*A*G*G*A*NCAGTGGAACGAAAACTCACG |
| VF2468-N7 | NA*G*C*A*G*C*G*T*C*NNNNNNNG*A*G*T*G*A*G*G*A*NCAGTGGAACGAAAACTCACG |
| test fwd | GCGACACGGAAATGTTGAATACTCAT |
| test rev | CAGCGAGTCAGTGAGCGA |
| adapter1 | ACACTCTTTCCCTACACGACGCTCTTCCGATCTT |
| adapter1(AAT) | ACACTCTTTCCCTACACGACGCTCTTCCGATCTAATT |
| adapter1(ATA) | ACACTCTTTCCCTACACGACGCTCTTCCGATCTATAT |
| adapter1(TAA) | ACACTCTTTCCCTACACGACGCTCTTCCGATCTTAAT |
| adapter1(CAC) | ACACTCTTTCCCTACACGACGCTCTTCCGATCTCACT |
| adapter2 | /5Phos/AGATCGGAAGAGCGGTTCAGCAGGAATGCCGAG |
| adapter2(AAT) | /5Phos/ATTAGATCGGAAGAGCGGTTCAGCAGGAATGCCGAG |
| adapter2(ATA) | /5Phos/TATAGATCGGAAGAGCGGTTCAGCAGGAATGCCGAG |
| adapter2(TAA) | /5Phos/TTAAGATCGGAAGAGCGGTTCAGCAGGAATGCCGAG |
| adapter2(CAC) | /5Phos/GTGAGATCGGAAGAGCGGTTCAGCAGGAATGCCGAG |
| PE1 | CAAGCAGAAGACGGCATACGAGATCGGTCTCGGCATTCCTGCTGAACCGCTCTTCCGATC |
| PE2 | AATGATACGGCGACCACCGAGATCTACACTCTTTCCCTACACGACGCTCTTCCGATCT |
| CCR5-224 1 fwd | ATACATCGGAGCCCTGCCAA |
| CCR5-224 1 rev | GGAAAAACAGGTCAGAGATGGC |
| CCR5-224 2 fwd | TCCTGCCTCCGCTCTACTCG |
| CCR5-224 2 rev | ACCCCAAAGGTGACCGTCCT |
| CCR5-224 3 fwd | TCCCACGTTTTCCCCTTGAC |
| CCR5-224 3 rev | GTCCCTCACGACGACCGACT |
| CCR5-224 4 fwd | GCACTGCCCCCAGAAATATTGGTT |
| CCR5-224 4 rev | TGGTTTGTTGGGGGATCAGG |
| CCR5-224 5 fwd | ATGCCACCCCTGCCAGATAA |
| CCR5-224 5 rev | GCCTACCTCAATGCAGGCAAA |

-continued

| oligonucleotide name | oligonucleotide sequence (5'→3') |
|---|---|
| CCR5-224 6 fwd | TCTGCTTCTGCCCTTCTGGA |
| CCR5-224 6 rev | GGAGGATCGCCAAGACCTGA |
| CCR5-224 7 fwd | CCCCAGTGCTTAACATAGTTCTTGG |
| CCR5-224 7 rev | ACTCCCAGACAAACCCCGCT |
| CCR5-224 8 fwd | GGCACCAGAACTTACTCACTGCC |
| CCR5-224 8 rev | TGTGAAGGCCCAAAACCCTG |
| CCR5-224 9 fwd | GTTTTGGGGGTCATGGCAAA |
| CCR5-224 9 rev | TGGGCAGCCCTAGGTCCTTT |
| CCR5-224 10 fwd | TTTCCCTGGTGATGCACTCCT |
| CCR5-224 10 rev | TGATGAGTAACTTGGGCGAAAA |
| CCR5-224 11 fwd | TTGGGGGAATGAGATTGGGA |
| CCR5-224 11 rev | GGAAAATCCAGCAAGGTGAAA |
| CCR5-224 13 fwd | CCTTCCCATGGTCACAGAGG |
| CCR5-224 13 rev | CAACTCTCTAACAGCAAAGTGGCA |
| CCR5-224 14 fwd | TCCTCCCGTTGAGGAAGCAC |
| CCR5-224 14 rev | GCCTCAAAAGCATAAACAGCA |
| CCR5-224 15 fwd | CAGACCGCTGCTGCTGAGAC |
| CCR5-224 15 rev | AGGGCGGACTCATTGCTTTG |
| CCR5-224 16 fwd | TGGGTTCCTCGGGTTCTCTG |
| CCR5-224 16 rev | GAAACCAGAAGTTCACAACAATGCTT |
| CCR5-224 17 fwd | AGGCATAAGCCACTGCACCC |
| CCR5-224 17 rev | TGGCAATGCCTAATCAGACCA |
| CCR5-224 18 fwd | GAGGATATTTTATTGCTGGCTCTTGC |
| CCR5-224 18 rev | GAGTTTGGGGAAAAGCCACTT |
| CCR5-224 20 fwd | GCTGAGGCCCACCTTTCCTT |
| CCR5-224 20 rev | TGCTCTGCCAACTGTGAGGG |
| CCR5-224 21 fwd | TGTTTTGGGTGCATGTGGGT |
| CCR5-224 21 rev | TCCAGGGAGTGAGGTGAAGACA |
| CCR5-224 22 fwd | CTGGGTCAGCTGGGCCATAC |
| CCR5-224 22 rev | TCACATCTCCGCCTCACGAT |
| CCR5-224 23 fwd | CCAGCCTTGGAAAAATGGACA |
| CCR5-224 23 rev | CTGACACAGTGGCCAGCAGC |
| CCR5-224 24 fwd | CATGGATGTAATGGGTTGTATCTGC |
| CCR5-224 24 rev | GAGGGCAGAAGGGGGTGAGT |
| CCR5-224 25 fwd | AGGATGCATTGTCCCCCAGA |
| CCR5-224 25 rev | TGGAGTGACATGTATGAAGCCA |
| CCR5-224 26 fwd | CGTTGGCTTGCAGAAGGGAC |
| CCR5-224 26 rev | TRGAACCCCGGATTTTTCAACC |

-continued

| oligonucleotide name | oligonucleotide sequence (5'→3') |
|---|---|
| CCR5-224 27 fwd | TGACCCAACTAAGTCTGTGACCC |
| CCR5-224 27 rev | TTGGGAAAGCTTTGATGCTGG |
| CCR5-224 28 fwd | TGGGTTGTGTTTTTGACTGACAGA |
| CCR5-224 28 rev | CCCTAGGGGTCACTGGAGCA |
| CCR5-224 29 fwd | CACCCCCATGCAGGAAAATG |
| CCR5-224 29 rev | TTGGCTGCTGGCATTTGGTA |
| CCR5-224 30 fwd | GGCCATTGGTTCTGGAGGAA |
| CCR5-224 30 rev | TCCGTTGCTTCATCCTTCCAA |
| CCR5-224 31 fwd | AGTCAGCAATGCCCCAGAGC |
| CCR5-224 31 rev | TGGAGAGGGTTTACTTTCCCAGA |
| CCR5-224 32 fwd | CCTGGGAGGGTGACTAGTTGGA |
| CCR5-224 32 rev | GCTCAGGGCCTGGCTTACAG |
| CCR5-224 33 fwd | TGGCAATTAGGATGTGCCAG |
| CCR5-224 33 rev | TCCACTCACAAATTTACCTTTCCAC |
| CCR5-224 34 fwd | TGCCCCACATCTTCACCAGA |
| CCR5-224 34 rev | CCGCATAAAGGAGGTGTCGG |
| CCR5-224 36 fwd | GTTGCATCTGCGGTCTTCCA |
| CCR5-224 36 rev | GGAGAGTCTTCCGCCTGTGTT |
| CCR5-224 37 fwd | TAGTGGCCCCAACATGCAAA |
| CCR5-224 37 rev | GCACATATCATGCACTGTGACTGTAA |
| VF2468 1 fwd | CCTTTCCAAAGCCCATTCCC |
| VF2468 1 rev | CAACCCCACACGCACAC |
| VF2468 2 fwd | TTCACTGCCTTCAGGCCTCC |
| VF2468 2 rev | AATGGCCAGAAAATTCCCAAA |
| VF2468 3 fwd | CACAGGGACCCAGGACTGCT |
| VF2468 3 rev | TGACTGGAACCGTGCAGCAT |
| VF2468 4 fwd | GCACCAGGCTTCTCTGCCAT |
| VF2468 4 rev | TCGGGGGTCCATGGTATTTG |
| VF2468 5 fwd | CCAAGGCGAGGACATTGAGG |
| VF2468 5 rev | CCCCAAGTCAGACCCTGCAT |
| VF2468 7 fwd | ACCATAGTCCAGCGGGGTCA |
| VF2468 7 rev | TTCTCCCCAAGGAAGGCTGA |
| VF2468 8 fwd | AGAAAGGGTGGTCGGGGAAG |
| VF2468 8 rev | GCCACCATGCCCAGTCTACA |
| VF2468 9 fwd | TTCCCATGGGGTCTCAGCTC |
| VF2468 9 rev | ATGGCCTTCCCCAACTGTGA |
| VF2468 10 fwd | CAGCAAGGATGCCCTTCACC |
| VF2468 10 rev | CGTTGTGATTGAGGAGACGAGG |

-continued

| oligonucleotide name | oligonucleotide sequence (5'→3') |
|---|---|
| VF2468 11 fwd | GGCTTGAGCTGGAAGGACCA |
| VF2468 11 rev | TGGAGCAACTGAACATCTTGGG |
| VF2468 12 fwd | AACCGAGTTTGCACCGTCGT |
| VF2468 12 rev | CATAACCACCAGGACATCCGC |
| VF2468 13 fwd | TATCCTCCCCTTTCCCCTGA |
| VF2468 13 rev | TGTTGCCAGAAGTATCAGGTCCC |
| VF2468 15 fwd | AGAACCCGGAATCCCTTTGC |
| VF2468 15 rev | GCAGAGAAGGCAGCAGCACA |
| VF2468 16 fwd | GGTCTCTGCCATGCCCAACT |
| VF2468 16 rev | TGGAGGAAGCAGGAAAGGCAT |
| VF2468 18 fwd | CCCCTTGGGATCCTTGTCCT |
| VF2468 18 rev | TCAACAGGCAGCTACAGGGC |
| VF2468 19 fwd | CTAGGCCTGTGGGCTGAGGA |
| VF2468 19 rev | CAAATGTTGGGGTGTGGGTG |
| VF2468 20 fwd | TACCTGAAACCCCTGGCCCT |
| VF2468 20 rev | CAAGCTGGATGTGGATGCAGAG |
| VF2468 21 fwd | CGGGGGCCTGACATTAGTGA |
| VF2468 21 rev | GCCTGAAGATGCATTTGCCC |
| VF2468 22 fwd | TGCATTGGCTCAAGAATTGGG |
| VF2468 22 rev | TCACACAGTGGTAATGGACAGGAA |
| VF2468 23 fwd | GCGCTCCCTGTGTTCAGTACC |
| VF2468 23 rev | GCGCAAGTTCCCCTTTCTGA |
| VF2468 24 fwd | TGTTTGGGTTATGGGGCAG |
| VF2468 24 rev | TCCAGCATCTGCTCCTGGTG |
| VF2468 25 fwd | AAGGAGACTTCTCAGGCCCCA |
| VF2468 25 rev | TGAAGGGAAGCCACAGCTCC |
| VF2468 26 fwd | CTTGGGGCAGACAGCATCT |
| VF2468 26 rev | GCCATGGGATGGCAGTTAGG |
| VF2468 27 fwd | TGGCCTCAAGCAATCCTCCT |
| VF2468 27 rev | TTCCATGGCAGTGAAGGGTG |
| VF2468 28 fwd | CCAAAGAGCCTGGAGGAGCA |
| VF2468 28 rev | CAGAGGGTGTGGTGGTGTCG |
| VF2468 29 fwd | CCAGCCTGTGAAGCTGGAAGTAA |
| VF2468 29 rev | CCAGTGGGCTGAGTGGATGA |
| VF2468 30 fwd | CATCTGAATGCCCATGCTGC |
| VF2468 30 rev | CCGCCACACCCATTCCTC |
| VF2468 31 fwd | CCTCAAAGAAACGGCTGCTGA |
| VF2468 31 rev | GCCGCTCGAAAAGAGGGAAT |

| oligonucleotide name | oligonucleotide sequence (5'→3') |
|---|---|
| VF2468 32 fwd | CGGGCTCTCCTCCTCAAAGA |
| VF2468 32 rev | GGCCCCTTGAAAAGAGGGAA |
| VF2468 33 fwd | GGAATCGCATGACCTGAGGC |
| VF2468 33 rev | CGGGCTCTCCTCCTCAAAGA |
| VF2468 34 fwd | CCCGCCAGACACATTCCTCT |
| VF2468 34 rev | CATCTGAATGCCCATGCTGC |
| VF2468 35 fwd | CCGCACCTTTTTCCTATGTGGT |
| VF2468 35 rev | TCAGATGTGCTAGGACACAGATGAC |
| VF2468 36 fwd | GGTACATGGGCCGCACTTTC |
| VF2468 36 rev | GGACAGCTGGGAATTGGTGG |
| VF2468 37 fwd | TTACACCTGCTGGCAGGCAA |
| VF2468 37 rev | GCTGGTGTGAGCAAGAGGCA |
| VF2468 38 fwd | TGGCCAAGCCTGCCTAACTC |
| VF2468 38 rev | TGATCAGTTAGCCCTGGGGG |
| VF2468 39 fwd | CCCCTTCTGCTCCTGCTTCA |
| VF2468 39 rev | CCTTCCTTGCAGCTCAAACCC |
| VF2468 40 fwd | TGATTTTCAGCGTGGAGGGC |
| VF2468 40 rev | ACGGCAAAGCCAGAGCAAAG |
| VF2468 41 fwd | AAGCTGGCAGCCACTCTTCA |
| VF2468 41 rev | TCTCAGGGCTTCTGTGTGCG |
| VF2468 42 fwd | TCGATTCTCCATACACCATCAAT |
| VF2468 42 rev | GCAACCAACTCCCAACAGGG |
| VF2468 43 fwd | AGGTCCTGGCATTGTCTGGG |
| VF2468 43 rev | TGGTTGCCTGTTTCACACCC |
| VF2468 45 fwd | CTGGGAGGCAGCCAGTCAAG |
| VF2468 45 rev | GCCCTGTAAGCTGAAGCTGGA |
| VF2468 46 fwd | CAGGTGTGCATTTTGTTGCCA |
| VF2468 46 rev | GCCTGCCAGGTATTTCCTGTGT |
| VF2468 47 fwd | TGGCCCTGGTCATGTGAAAA |
| VF2468 47 rev | AACTGCAAGTGGCCTCCCAG |
| VF2468 48 fwd | TTGATAAGGGCGGTGCCACT |
| VF2468 48 rev | TAGAGGGAGGTGCTTGCCCA |
| VF2468 49 fwd | CATCCCCTTGACCAACAGGC |
| VF2468 49 rev | GCTTGGGCACTGATCCTGCT |
| VF2468 50 fwd | ACTGCCAATGGACCCTCTCG |
| VF2468 50 rev | GAGTTGCCCAGGTCAGCCAT |
| VF2468 51 fwd | GGGGAGCTAGAATGGTGGGC |
| VF2468 51 rev | CAAGGTACACAGCTGCCCAGG |

-continued

| oligonucleotide name | oligonucleotide sequence (5'→3') |
|---|---|
| VF2468 52 fwd | CCCATGCTGGTCCTGCTGTT |
| VF2468 52 rev | GGAGGCTCAGCGGAGAGGAT |
| VF2468 53 fwd | GGGGTCACCAGGGAAGGTTT |
| VF2468 53 rev | AGTTGCGGGGAGGTGCTACA |
| VF2468 54 fwd | TGCCCAGAGACCTTCCAAGC |
| VF2468 54 rev | TGGCCAAGGCCTCTCTAAGC |
| VF2468 56 fwd | GCCAATGTGCAATCGAGACG |
| VF2468 56 rev | TGCATGCCTCTGACTGATGCT |
| VF2468 57 fwd | TGACTTGAACTGGGTCCCCC |
| VF2468 57 rev | CTGGGGCTACAGCCCTCCTT |
| VF2468 58 fwd | CCCAATCCAGACACCACACG |
| VF2468 58 rev | TGCAGATTTTAGGGGTTGCCA |
| VF2468 59 fwd | GGTGAGGAAGGATGGGGGTT |
| VF2468 59 rev | GTAGGCTCTGCCACGCCAGT |
| VF2468 60 fwd | TGCCCATGTTGTTGCTCCAC |
| VF2468 60 rev | GACAAGTTAGACCATCCTAGCCCTCA |
| VF2468 61 fwd | TCACAGCTCCCCTTTCTCGG |
| VF2468 61 rev | TGTGCCTCCACTGACGCATT |
| VF2468 62 fwd | CCTAGGCACAGTGGGGGATG |
| VF2468 62 rev | GGGCTGACACACTGAGGGCT |
| VF2468 63 fwd | CCATGAGCACAATTGCCAAAA |
| VF2468 63 rev | TGAGTTATTTCGAAAGAGGAAACAGTG |
| VF2468 64 fwd | CTGCCAAGAACAGGAGGGGA |
| VF2468 64 rev | AGCCCATCTACCATCCAGCG |
| VF2468 66 fwd | ATCGGGGCAGGGCTAGAGTC |
| VF2468 66 rev | CCCCTGGCATTCCCTACACA |
| VF2468 67 fwd | GCCGTTAGTGCATTTGCCTG |
| VF2468 67 rev | TCCCTTCAACCCCTGTAGTGC |
| VF2468 68 fwd | GTTCCTCCCAGAGTGGGGCT |
| VF2468 68 rev | ACTGAGGGAGGCAGCACTGG |
| VF2468 69 fwd | AGGCCTGGCGGTAACCTTG |
| VF2468 69 rev | AAGCTCCAGCCCTGTACCCC |
| VF2468 70 fwd | GGGATCCTACAGGATGGGACAA |
| VF2468 70 rev | CAGCCCAGGACAAGGGTAGC |
| VF2468 71 fwd | GCCACCAATGTCCACTGGTT |
| VF2468 71 rev | TTCCCCAAGCAGTCCAGCTC |
| VF2468 72 fwd | GCACCAGCCTCTTCGATGGT |
| VF2468 72 rev | CCTTTGGCAGACTGTGGCCT |

| oligonucleotide name | oligonucleotide sequence (5'→3') |
|---|---|
| VF2468 73 fwd | AATGGGGCAAAAGGCAAGAAA |
| VF2468 73 rev | CAGACCTCGTGGTGCATGTG |
| VF2468 74 fwd | TGGCGAGATAGGCTCTGCTACA |
| VF2468 74 rev | TGGACAGGGAATTACTCAGACCAG |
| VF2468 75 fwd | TGTGGGCATGAGACCACAGG |
| VF2468 75 rev | TTTGACTCCCCCGCATTGTT |
| VF2468 76 fwd | TCCTATTTTCAGATGCACTCGAACC |
| VF2468 76 rev | GTGCTCACTGAAGCCCACCA |
| VF2468 77 fwd | GGACCTTCTTGCCCTCATGATTC |
| VF2468 77 rev | GGGAACTGTGCCTTTGCGTC |
| VF2468 78 fwd | CCTTGCAAAGGCTTGCCTAAA |
| VF2468 78 rev | GGCAGGCACCTGTAGTCCCA |
| VF2468 79 fwd | TGGCTTGCAGAGGAGGTGAG |
| VF2468 79 rev | CAGGGAAGGGTGTTGGCTTG |
| VF2468 80 fwd | GCTTCAGCACATCAGTGGCG |
| VF2468 80 rev | TTCGCCCAGCTCATCAACAA |
| VF2468 81 fwd | GGTGAGGCCACTGTAAGCCAA |
| VF2468 81 rev | TGGGCTGCCATGACAAACAG |
| VF2468 83 fwd | GAGTTGAGCTGTCAGCGGGG |
| VF2468 83 rev | GAAGCCAACTGCCTTGTGAGC |
| VF2468 84 fwd | TGTTTTCTGCAGTTTTGCAGGG |
| VF2468 84 rev | GGCTCAGGGAGTTTGAGCCA |
| VF2468 85 fwd | GCTCTGGCACCAGGCACACT |
| VF2468 85 rev | GGGAGAGAACCATGAATTTCCCA |
| VF2468 86 fwd | GCCAAACCCTTTCCAGGGAG |
| VF2468 86 rev | CCCACCCTATGCACAGAGCC |
| VF2468 87 fwd | CCTCAGCCAGTTGGAATCGG |
| VF2468 87 rev | CAACGGTTTAGTTTAGTTCCGGTTT |
| VF2468 88 fwd | TGGGTGGTGAAAATGGGGTT |
| VF2468 88 rev | GGTGGGGTATGCACTGGTCA |
| VF2468 89 fwd | GGAATGTGTGGAACTCAATTTCTTT |
| VF2468 89 rev | TTGCTTGCAGGGTGTGGAAA |
| VF2468 90 fwd | CCACAAGGGTCATCTGGGGA |
| VF2468 90 rev | CGGAGGCATCATCCACTGAG |
| VF2468 91 fwd | CCTGGAGTGGTTTGGCTTCG |
| VF2468 91 rev | TGGAGCCCTGGAGTTCTTGG |
| VF2468 92 fwd | GGCTCCTGGGGTCATTTCC |
| VF2468 92 rev | TGTGCTCCATCCTCCTCCCT |

| oligonucleotide name | oligonucleotide sequence (5'→3') |
|---|---|
| VF2468 93 fwd | GTGTGTTTCCGCACACCCTG |
| VF2468 93 rev | GCTCTTGGCTTCCCAACCCT |
| VF2468 94 fwd | CCATCGCCGTGTCTGAGTGT |
| VF2468 94 rev | CAGCAGGAACATCATCCCCC |
| VF2468 95 fwd | AGGCAATGGCACCAAAATGG |
| VF2468 95 rev | GCAGCCTTCACCATACCTGTGA |
| VF2468 96 fwd | TTTTGACTTTGAGAACCCCCTGA |
| VF2468 96 rev | CCTTGTCCTTTCTCAGTTAGACACA |
| VF2468 97 fwd | GCTGAGTGCAAAGCTCAGGGA |
| VF2468 97 rev | GGCAACACAGCAAGACCCCT |

Table 9: Oligonucleotides used in this study. Oligonucleotides "[ZFN] [#] fwd/rev" were ordered from Invitrogen. All other oligonucleotides were ordered from Integrated DNA Technologies. 'N' refers to machine mixed incorporation of 'A', 'C', 'G', or 'T.' An asterisk indicates that the preceding nucleotide was incorporated as a mixture containing 79 mol % of that nucleotide and 7 mol % each of the other canonical nucleotides. "/5Phos/" denotes a 5' phosphate group installed during synthesis. Sequences correspond, from top left to bottom right, to SEQ ID NOs:654-924.

VF2468 Data

Potential VF2468 genomic off-target sites. The human genome was searched for DNA sequences surviving in vitro selection for VF2468 cleavage. Sites marked with an 'X' were found in the in vitro selection dataset. 'T' refers to the total number of mutations in the site, and '(+)' and '(−)' to the number of mutations in the (+) and (−) half-sites, respectively. The sequences of the sites are listed as they appear in the genome, therefore the (−) half-site is listed in the reverse sense as it is in the sequence profiles. Sequence (+) half-sites correspond, from top to bottom, to SEQ ID NOs:925-3538; sequence (−) half-sites correspond, from top to bottom, to SEQ ID NOs:3539-6152; full sequences with spacers correspond, from top to bottom, to SEQ ID NOs: 6153-8766.

| # of mutations | | | | | | VF2468 concentration | | | |
|---|---|---|---|---|---|---|---|---|---|
| T | (−) | (+) | (−) site | spacer | (+) site | 4 nM | 2 nM | 10.5 nM | nM |
| 2 | 1 | 1 | AGCAGCTTC | CTTTT | GAGTGAGAA | X | X | X | X |
| 2 | 1 | 1 | AGCATCGTC | ATCAGA | CAGTGAGGA | X | X | X | X |
| 2 | 1 | 1 | AGCAACGTC | GTAGT | GATTGAGGA | X | X | X | X |
| 2 | 2 | 0 | AGCTGGGTC | ATGAG | GAGTGAGGA | X | X | X | X |
| 2 | 2 | 0 | AGCTGGGTC | ATGAG | GAGTGAGGA | X | X | X | X |
| 2 | 2 | 0 | AGCAACTTC | TGGAAA | GAGTGAGGA | X | X | X | X |
| 2 | 2 | 0 | AGCTGAGTC | TTAAG | GAGTGAGGA | X | X | X | X |
| 2 | 2 | 0 | TCCAGCGTC | CTCCCA | GAGTGAGGA | X | X | X | X |
| 2 | 2 | 0 | TGCAGCGTT | AAAATA | GAGTGAGGA | X | X | X | X |
| 2 | 2 | 0 | AGCACCTTC | AATTG | GAGTGAGGA | X | X | X | X |
| 2 | 2 | 0 | TGCAGCGGC | GTAGGG | GAGTGAGGA | X | X | X | X |
| 2 | 2 | 0 | AGCAGGGTT | CTTCAA | GAGTGAGGA | X | X | X | X |
| 2 | 2 | 0 | AGCAGCATA | GATATG | GAGTGAGGA | X | X | X | X |
| 2 | 2 | 0 | AACAGCTTC | TCTGAG | GAGTGAGGA | X | X | X | X |
| 2 | 2 | 0 | TGCAGGGTC | GGGCAG | GAGTGAGGA | X | X | X | X |
| 2 | 2 | 0 | AGCAAAGTC | AAACA | GAGTGAGGA | X | X | X | X |
| 2 | 2 | 0 | AACAGCTTC | TCGGGA | GAGTGAGGA | X | X | X | X |
| 2 | 2 | 0 | AGTAGCGGC | AAATT | GAGTGAGGA | X | X | X | X |
| 2 | 2 | 0 | AGCTGAGTC | CTAAA | GAGTGAGGA | X | X | X | X |
| 2 | 2 | 0 | AGCAGCGAG | AAAGA | GAGTGAGGA | X | X | X | X |
| 2 | 2 | 0 | TGCAGTGTC | CACAA | GAGTGAGGA | X | X | X | X |
| 2 | 2 | 0 | AGCAGCATA | ATAGCA | GAGTGAGGA | X | X | X | X |
| 2 | 2 | 0 | AGCAGCATA | TCAGG | GAGTGAGGA | X | X | X | X |
| 2 | 2 | 0 | AGCAGCGGT | CTTAG | GAGTGAGGA | X | X | X | X |
| 2 | 2 | 0 | AACAGCTTC | ATCTCG | GAGTGAGGA | X | X | X | X |
| 2 | 2 | 0 | GGCAGAGTC | CTAGA | GAGTGAGGA | X | X | X | X |
| 2 | 2 | 0 | AGCTGTGTC | TTGGA | GAGTGAGGA | X | X | X | X |

| # of mutations T | (-) | (+) | (-) site | spacer | (+) site | VF2468 concentration 4 nM | 2 nM | 10.5 nM | nM |
|---|---|---|---|---|---|---|---|---|---|
| 2 | 2 | 0 | AGTGGCGTC | CCAGT | GAGTGAGGA | X | X | X | X |
| 2 | 2 | 0 | AGCTGTGTC | CACAG | GAGTGAGGA | X | X | X | X |
| 3 | 1 | 2 | AGCAGCGGC | TTAAGG | GGGTGAGGT | X | X | X | X |
| 3 | 1 | 2 | AGCAACGTC | TAACCC | GAGTGTTGA | X | X | X | X |
| 3 | 1 | 2 | AGCACCGTC | CCCCT | CAGTGAGGC | X | X | X | X |
| 3 | 1 | 2 | AGCAGCGGC | GGCTG | CAGTGAGGC | X | X | X | X |
| 3 | 1 | 2 | AGCAGTGTC | TAAAAG | GAGTGAGAT | X | X | X | X |
| 3 | 1 | 2 | AGCAACGTC | CATAGT | GTGTGAGAA | X | X | X | X |
| 3 | 2 | 1 | AGAAACGTC | GTGGAG | GAGTGAGGG | X | X | X | X |
| 3 | 2 | 1 | AGCATAGTC | TAGGCC | GAGTGAGGC | X | X | X | X |
| 3 | 2 | 1 | AGCAACTTC | ATCTT | GAGTGAGGG | X | X | X | X |
| 3 | 2 | 1 | AGCAGGGTG | GCGTG | GAGTGAGGC | X | X | X | X |
| 3 | 2 | 1 | AGCACGGTC | ATGAT | GAGTGAGGC | X | X | X | X |
| 3 | 2 | 1 | AGCATTGTC | TCCTG | GAGTGAGGG | X | X | X | X |
| 3 | 2 | 1 | AGCACCGTG | GCTTC | GAGTGAGGC | X | X | X | X |
| 3 | 2 | 1 | AGCAACTTC | CTGGC | GAGTGAGGG | X | X | X | X |
| 3 | 2 | 1 | AGCAACATC | TGGTTG | GAGTGAGGG | X | X | X | X |
| 3 | 2 | 1 | GGCAGCGGC | CGCTGT | GAGTGAGGT | X | X | X | X |
| 3 | 2 | 1 | AGCATTGTC | TCATGT | GAGTGAGGT | X | X | X | X |
| 3 | 2 | 1 | AGCAGCAGC | TAGGG | GAGTGAGGG | X | X | X | X |
| 3 | 2 | 1 | AGCAGCAGC | CCACAG | GAGTGAGGG | X | X | X | X |
| 3 | 2 | 1 | ATCAGAGTC | TCTGG | GAGTGAGGG | X | X | X | X |
| 3 | 2 | 1 | ATCAGTGTC | CCTCAG | GAGTGAGGG | X | X | X | X |
| 3 | 2 | 1 | AGCAACATC | ATCTT | GAGTGAGGG | X | X | X | X |
| 3 | 2 | 1 | AGCATGGTC | CCAAG | GAGTGAGGG | X | X | X | X |
| 3 | 2 | 1 | AGCAAAGTC | TGTACT | GAGTGAGGG | X | X | X | X |
| 3 | 2 | 1 | AGCAGCTCC | TCTCC | GAGTGAGGT | X | X | X | X |
| 3 | 2 | 1 | AGCAATGTC | AAAAA | GAGTGAGGG | X | X | X | X |
| 3 | 2 | 1 | AGTAGCGTT | TTTAG | GAGTGAGGT | X | X | X | X |
| 3 | 2 | 1 | GGCAGAGTC | AGGGCT | GAGTGAGGC | X | X | X | X |
| 3 | 2 | 1 | TGCAGCTTC | ATGGT | GAGTGAGGT | X | X | X | X |
| 3 | 3 | 0 | AGCATAGTT | ACCTGG | GAGTGAGGA | X | X | X | X |
| 3 | 3 | 0 | AGTAAAGTC | TAAGTA | GAGTGAGGA | X | X | X | X |
| 3 | 3 | 0 | AGCATTGTT | CTGCG | GAGTGAGGA | X | X | X | X |
| 4 | 3 | 1 | TGCAGTCTC | CTTGG | GAGTGAGGT | X | X | X | X |
| 2 | 0 | 2 | AGCAGCGTC | CACTTC | CAGAGAGGA | X | X | X |  |
| 2 | 1 | 1 | AGCAGCGTG | GACCCA | GAGTGAGCA | X | X | X |  |
| 2 | 1 | 1 | AGCAGCGCC | AATCC | GAGTGAGAA | X | X | X |  |
| 2 | 1 | 1 | AGCAGCGGC | AGGCT | GAGAGAGGA | X | X | X |  |
| 2 | 1 | 1 | AGCAGCTTC | TGCCTT | GAGTGAGTA | X | X | X |  |
| 2 | 1 | 1 | AGCAGCTTC | ACTGT | CAGTGAGGA | X | X | X |  |
| 2 | 1 | 1 | ATCAGCGTC | TTCAG | AAGTGAGGA | X | X | X |  |
| 2 | 1 | 1 | AGCAGCGTG | GACCCA | GAGTGAGCA | X | X | X |  |
| 2 | 1 | 1 | AGCAGGGTC | AAGAAA | GAGTGAGTA | X | X | X |  |
| 2 | 1 | 1 | AGCAGCGTT | ACACA | GAGTGGGGA | X | X | X |  |
| 2 | 1 | 1 | AGCAGCGGC | AAGAGA | GAATGAGGA | X | X | X |  |
| 2 | 1 | 1 | AGCAGAGTC | CAGGC | AAGTGAGGA | X | X | X |  |
| 2 | 1 | 1 | AGCAGAGTC | CAGGC | AAGTGAGGA | X | X | X |  |
| 2 | 1 | 1 | AGCAGGGTC | TGGGTA | GAGTGATGA | X | X | X |  |
| 2 | 1 | 1 | AGCAGCGTG | GACCCA | GAGTGAGCA | X | X | X |  |
| 2 | 2 | 0 | AGCAGCAGC | TAGCTA | GAGTGAGGA | X | X | X |  |
| 2 | 2 | 0 | AGGAGCTTC | ACTAA | GAGTGAGGA | X | X | X |  |
| 2 | 2 | 0 | AGCAGCCTG | CAATA | GAGTGAGGA | X | X | X |  |
| 2 | 2 | 0 | ACCAGTGTC | TGAGCT | GAGTGAGGA | X | X | X |  |
| 2 | 2 | 0 | AACAGAGTC | CCCAT | GAGTGAGGA | X | X | X |  |
| 2 | 2 | 0 | AGCAGCCTG | GCCAGG | GAGTGAGGA | X | X | X |  |
| 2 | 2 | 0 | AGCAGCAGC | AGTGA | GAGTGAGGA | X | X | X |  |
| 2 | 2 | 0 | ATCAGAGTC | TTAGG | GAGTGAGGA | X | X | X |  |
| 2 | 2 | 0 | AGCGGGGTC | TAGGGG | GAGTGAGGA | X | X | X |  |
| 2 | 2 | 0 | AGCAGCGGA | CAAGT | GAGTGAGGA | X | X | X |  |
| 3 | 0 | 3 | AGCAGCGTC | CCTGCC | TAGGGAGGG | X | X | X |  |
| 3 | 0 | 3 | AGCAGCGTC | TTTTCT | ATGTGAGGC | X | X | X |  |
| 3 | 0 | 3 | AGCAGCGTC | ACCTCT | GTGTGGGGC | X | X | X |  |
| 3 | 0 | 3 | AGCAGCGTC | TAAGG | GAGGGGGT | X | X | X |  |
| 3 | 0 | 3 | AGCAGCGTC | TTGGG | GTGTGGGGC | X | X | X |  |
| 3 | 0 | 3 | AGCAGCGTC | TAGAG | TAGAGAGGT | X | X | X |  |
| 3 | 1 | 2 | AGCAGGGTC | TCCCAG | GAGTGTGAA | X | X | X |  |
| 3 | 1 | 2 | AGCAGTGTC | TATTT | CAGTGAGGG | X | X | X |  |
| 3 | 1 | 2 | AGCAGGGTC | AGCCCA | GAGTGGGGG | X | X | X |  |
| 3 | 1 | 2 | AGCAGGGTC | AGGCA | CAGTGAGGC | X | X | X |  |
| 3 | 1 | 2 | AGCAGGGTC | CTCTG | GAGTGGGGG | X | X | X |  |

| # of mutations T | (−) | (+) | (−) site | spacer | (+) site | 4 nM | 2 nM | 10.5 nM |
|---|---|---|---|---|---|---|---|---|
| 3 | 1 | 2 | GGCAGCGTC | CGGAG | GAGTGAAGG | X | X | X |
| 3 | 1 | 2 | GGCAGCGTC | ACTCCA | GAGTTAGGT | X | X | X |
| 3 | 1 | 2 | AGCAGGGTC | ATTCAT | CAGTGAGGC | X | X | X |
| 3 | 1 | 2 | AGCAGAGTC | CTGTCA | GAGGGAGGC | X | X | X |
| 3 | 1 | 2 | AGCAGCATC | TTCTG | GAGTGAGAC | X | X | X |
| 3 | 1 | 2 | AGCATCGTC | TTTCT | GTGTGAGGC | X | X | X |
| 3 | 1 | 2 | AGCAGTGTC | TCACAG | GAGGGAGGG | X | X | X |
| 3 | 1 | 2 | GGCAGCGTC | CAGGA | GAGAGAGGT | X | X | X |
| 3 | 1 | 2 | AGCAGCGGC | CCCGG | GAGTTAGGT | X | X | X |
| 3 | 1 | 2 | AGCAGCGGC | GGGTGG | GAGTGGGGG | X | X | X |
| 3 | 1 | 2 | AGCAGTGTC | CAGAC | GAGGGAGGT | X | X | X |
| 3 | 1 | 2 | AGCAGTGTC | TATGA | GAGGGAGGG | X | X | X |
| 3 | 1 | 2 | AGCAGTGTC | AGCCAT | GAGGGAGGG | X | X | X |
| 3 | 1 | 2 | AGCAGTGTC | CCTGTG | GAGGGAGGT | X | X | X |
| 3 | 1 | 2 | AGCACCGTC | TGCCA | GAGTGGGCA | X | X | X |
| 3 | 2 | 1 | AGCCACGTC | CACACT | AGTGAGGA | X | X | X |
| 3 | 2 | 1 | AGTAGCGCC | AAAAG | GAGTGAGGT | X | X | X |
| 3 | 2 | 1 | AACAGGGTC | TTTGAC | GAGTGAGGC | X | X | X |
| 3 | 2 | 1 | GGCAGGGTC | TCAAT | GAGTGAGGG | X | X | X |
| 3 | 2 | 1 | AACAGGGTC | CCTGA | GAGTGAGGG | X | X | X |
| 3 | 2 | 1 | AGGAGAGTC | CAGGT | GAGTGAGGG | X | X | X |
| 3 | 2 | 1 | AGCAGCCGC | CAACA | GAGTGAGGG | X | X | X |
| 3 | 2 | 1 | GGCAGAGTC | AGTGTT | GAGTGAGGG | X | X | X |
| 3 | 2 | 1 | AGCAGTGTG | TGAGCT | GAGTGAGGC | X | X | X |
| 3 | 2 | 1 | AGCATCTTC | CAGTG | GAGTGAGGG | X | X | X |
| 3 | 2 | 1 | AGCAGAGTG | GTTGA | GAGTGAGGT | X | X | X |
| 3 | 2 | 1 | ATCAGTGTC | CCAGA | GAGTGAGGG | X | X | X |
| 3 | 2 | 1 | TTCAGCGTC | CAAGAA | GAGTGAGGT | X | X | X |
| 3 | 2 | 1 | AGCAACTTC | CGGACA | GAGTAAGGA | X | X | X |
| 3 | 2 | 1 | AGCAGCGGG | AGATG | GAGTGAGGC | X | X | X |
| 3 | 2 | 1 | AGTAGCGTG | GAGAG | GAGTGAGGT | X | X | X |
| 3 | 2 | 1 | AGCTGCATC | TTTGG | GAGTGAGGT | X | X | X |
| 3 | 2 | 1 | ATCAGAGTC | AAAGAA | GAGTGAGGT | X | X | X |
| 3 | 2 | 1 | AGCAGGATC | TGAAAT | GAGTGAGGT | X | X | X |
| 3 | 2 | 1 | AGCCACGTC | CAGTTT | TAGTGAGGA | X | X | X |
| 3 | 2 | 1 | AGCAATGTC | TCAAAT | CAGTGAGGA | X | X | X |
| 3 | 2 | 1 | AGCAATGTC | TGAAA | CAGTGAGGA | X | X | X |
| 3 | 2 | 1 | GGCTGCGTC | ATCGG | GAGTGAGGT | X | X | X |
| 3 | 2 | 1 | GGCAGAGTC | AAAAT | GAGTGAGGT | X | X | X |
| 3 | 2 | 1 | AGCAGTGTG | CATGT | GAGTGAGGT | X | X | X |
| 3 | 3 | 0 | GGCAACATC | AAACAG | GAGTGAGGA | X | X | X |
| 3 | 3 | 0 | CCCAGCGGC | TGGCAG | GAGTGAGGA | X | X | X |
| 3 | 3 | 0 | AGCCTGGTC | GGAGAG | GAGTGAGGA | X | X | X |
| 3 | 3 | 0 | TGCAGTCTC | TATGG | GAGTGAGGA | X | X | X |
| 3 | 3 | 0 | AGCATTGTA | GAGGC | GAGTGAGGA | X | X | X |
| 3 | 3 | 0 | AGCCTGGTC | TCACA | GAGTGAGGA | X | X | X |
| 3 | 3 | 0 | AGCATAGTG | AATAT | GAGTGAGGA | X | X | X |
| 3 | 3 | 0 | AGCAAAGGC | ACCAG | GAGTGAGGA | X | X | X |
| 3 | 3 | 0 | AACATGGTC | CACGT | GAGTGAGGA | X | X | X |
| 3 | 3 | 0 | AGCTTTGTC | AACCTA | GAGTGAGGA | X | X | X |
| 3 | 3 | 0 | AGCAAAGGC | AAAAA | GAGTGAGGA | X | X | X |
| 3 | 3 | 0 | ATCAAGGTC | TTTTG | GAGTGAGGA | X | X | X |
| 3 | 3 | 0 | GCCAGTGTC | TCGTCT | GAGTGAGGA | X | X | X |
| 3 | 3 | 0 | TGCAAAGTC | AGATCT | GAGTGAGGA | X | X | X |
| 4 | 1 | 3 | AGCAACGTC | TACAG | GAGGAAGGT | X | X | X |
| 4 | 1 | 3 | AGCAACGTC | CCAGGA | AAGTGAAGG | X | X | X |
| 4 | 2 | 2 | GGCAGTGTC | CAGTAG | GAGTGAGAT | X | X | X |
| 4 | 2 | 2 | AGCAAAGTC | TCACA | AAGTGAGGT | X | X | X |
| 4 | 3 | 1 | TGCTGTGTC | AAACCC | GAGTGAGGT | X | X | X |
| 4 | 3 | 1 | GGCAAGGTC | TCTGTG | GAGTGAGGG | X | X | X |
| 4 | 3 | 1 | ATCAACGTG | TCTCA | GAGTGAGGC | X | X | X |
| 2 | 0 | 2 | AGCAGCGTC | TGAGGC | GGGTGAGAA | X | X | X |
| 2 | 0 | 2 | AGCAGCGTC | TGCATG | GTGTGGGGA | X | X | X |
| 2 | 1 | 1 | AGCAGAGTC | AGGCA | GAGTGAGAA | X | X | X |
| 2 | 1 | 1 | AGCAGCTTC | ATTTAT | GAGTGAGCA | X | X | X |
| 2 | 1 | 1 | GGCAGCGTC | CTTCT | GAGTGAGCA | X | X | X |
| 2 | 1 | 1 | AGCAGTGTC | GTGAA | GAGTCAGGA | X | X | X |
| 2 | 1 | 1 | AGCAGCTTC | CGGGGA | GAGAGAGGA | X | X | X |
| 2 | 2 | 0 | AGCAGCTGC | GGACC | GAGTGAGGA | X | X | X |
| 2 | 2 | 0 | AGCAGTGGC | ATTAA | GAGTGAGGA | X | X | X |
| 2 | 2 | 0 | AGCAGCATG | CACAT | GAGTGAGGA | X | X | X |

| # of mutations T | (−) | (+) | (−) site | spacer | (+) site | VF2468 concentration 4 nM | 2 nM | 10.5 nM |
|---|---|---|---|---|---|---|---|---|
| 2 | 2 | 0 | AGCAGCATG | ACCAA | GAGTGAGGA | X | X | X |
| 2 | 2 | 0 | ACCAGGGTC | TGTGGG | GAGTGAGGA | X | X | X |
| 2 | 2 | 0 | AGCAGCATG | AAAAGG | GAGTGAGGA | X | X | X |
| 2 | 2 | 0 | AGCAGGGTG | ATGGA | GAGTGAGGA | X | X | X |
| 2 | 2 | 0 | AGCAGTGAC | CGAAG | GAGTGAGGA | X | X | X |
| 2 | 2 | 0 | AGCAGATTC | CTCAG | GAGTGAGGA | X | X | X |
| 2 | 2 | 0 | ATCAGCGTG | GCCAT | GAGTGAGGA | X | X | X |
| 2 | 2 | 0 | AGCAGGGGC | AAGAGA | GAGTGAGGA | X | X | X |
| 2 | 2 | 0 | AGCGCCGTC | CACAGG | GAGTGAGGA | X | X | X |
| 3 | 0 | 3 | AGCAGCGTC | CCCTG | GAGTGGCCA | X | X | X |
| 3 | 0 | 3 | AGCAGCGTC | CAGTGG | GAGTGGGCC | X | X | X |
| 3 | 0 | 3 | AGCAGCGTC | CTTCCT | CAGTGAGAC | X | X | X |
| 3 | 1 | 2 | AGCAGCGGC | GGCGGG | GAGGGAGGC | X | X | X |
| 3 | 1 | 2 | AGCAGAGTC | TGTTGA | GAGTGAGAC | X | X | X |
| 3 | 1 | 2 | TGCAGCGTC | AGAAG | GTGTGAGGC | X | X | X |
| 3 | 1 | 2 | AGCAGCGTG | CCTCT | GGGTGAGGC | X | X | X |
| 3 | 1 | 2 | AGCAGCTTC | CATCTG | GAGTGAGTC | X | X | X |
| 3 | 1 | 2 | AGCAGCATC | TGCTCT | TAGTGAGGC | X | X | X |
| 3 | 1 | 2 | AGCAACGTC | CTGCA | GAGGGAGAA | X | X | X |
| 3 | 1 | 2 | AGCAGCGGC | CCGCA | GAGGGAGGC | X | X | X |
| 3 | 1 | 2 | AGCAACGTC | AGCAA | CAGTGAGAA | X | X | X |
| 3 | 1 | 2 | AGTAGCGTC | TCGAA | GAGAGAGGC | X | X | X |
| 3 | 1 | 2 | AGCAGCGTT | TTCAG | GAGGGAGGG | X | X | X |
| 3 | 1 | 2 | AGCAGCGGC | ACCCT | GGGTGAGGC | X | X | X |
| 3 | 2 | 1 | AGCAAGGTC | AACTCA | GAGTGAGAA | X | X | X |
| 3 | 2 | 1 | AGCATGGTC | AGTTTC | TAGTGAGGA | X | X | X |
| 3 | 2 | 1 | AGTAGGGTC | ACGCCA | GAGTGAGGC | X | X | X |
| 3 | 2 | 1 | ATCAGGGTC | CTGTT | GAGTGAGGG | X | X | X |
| 3 | 2 | 1 | AGCATGGTC | TTTTTC | TAGTGAGGA | X | X | X |
| 3 | 2 | 1 | AGCAGGGTA | AGAGGG | GAGTGAGGG | X | X | X |
| 3 | 2 | 1 | GGCAACGTC | AACTCA | GAGTGAGAA | X | X | X |
| 3 | 2 | 1 | GCCAGCGTC | TTGGGT | GAGTGAGGT | X | X | X |
| 3 | 2 | 1 | AGCAGCTTT | CTGCT | GAGTGAGGC | X | X | X |
| 3 | 2 | 1 | AGCAGTGGC | TGCGG | GAGTGAGGC | X | X | X |
| 3 | 2 | 1 | GGCAGCATC | TGGGC | GAGTGAGGC | X | X | X |
| 3 | 2 | 1 | GGCAGCATC | TGAAT | GAGTGAGGC | X | X | X |
| 3 | 2 | 1 | AGCAGTGTA | TGTGG | GAGTGAGGT | X | X | X |
| 3 | 2 | 1 | AGGAGAGTC | CCTGG | GAGTGAGGC | X | X | X |
| 3 | 2 | 1 | AGCATGGTC | AGATTC | TAGTGAGGA | X | X | X |
| 3 | 2 | 1 | ATCAGGGTC | TTGAGG | GAGTGAGGT | X | X | X |
| 3 | 2 | 1 | AACAGCGTG | CTGTA | GAGTGAGGT | X | X | X |
| 3 | 2 | 1 | AGTAGCTTC | TGTGG | GAGTGAGGC | X | X | X |
| 3 | 2 | 1 | AGCAACTTC | TTGAT | GAGTGAGAA | X | X | X |
| 3 | 2 | 1 | AGCATGGTC | AGGTTC | TAGTGAGGA | X | X | X |
| 3 | 2 | 1 | AGAAGTGTC | AGAGTA | GAGTGAGGC | X | X | X |
| 3 | 2 | 1 | AACAGCGGC | ATGGG | GAGTGAGGC | X | X | X |
| 3 | 2 | 1 | AGCAGTGGC | ATCTAG | GAGTGAGGC | X | X | X |
| 3 | 3 | 0 | AAAAGTGTC | ATATAG | GAGTGAGGA | X | X | X |
| 3 | 3 | 0 | AGCAATGGC | TGGAT | GAGTGAGGA | X | X | X |
| 3 | 3 | 0 | GCCACCGTC | GGTGAG | GAGTGAGGA | X | X | X |
| 3 | 3 | 0 | AAAAGTGTC | AGTAGA | GAGTGAGGA | X | X | X |
| 3 | 3 | 0 | AACATTGTC | TAGTGG | GAGTGAGGA | X | X | X |
| 3 | 3 | 0 | AACATTGTC | TAGTGA | GAGTGAGGA | X | X | X |
| 3 | 3 | 0 | AACATTGTC | TAGTGG | GAGTGAGGA | X | X | X |
| 3 | 3 | 0 | AACATTGTC | TAGTGA | GAGTGAGGA | X | X | X |
| 3 | 3 | 0 | AACATTGTC | TAGTGG | GAGTGAGGA | X | X | X |
| 3 | 3 | 0 | AACATTGTC | TAGTGA | GAGTGAGGA | X | X | X |
| 3 | 3 | 0 | AACATTGTC | TAGTGG | GAGTGAGGA | X | X | X |
| 3 | 3 | 0 | AACATTGTC | TAGTGA | GAGTGAGGA | X | X | X |
| 3 | 3 | 0 | AACATTGTC | TAGTGG | GAGTGAGGA | X | X | X |
| 3 | 3 | 0 | AACATTGTC | TAGTGA | GAGTGAGGA | X | X | X |
| 3 | 3 | 0 | AACATTGTC | TAGTGG | GAGTGAGGA | X | X | X |
| 3 | 3 | 0 | AACATTGTC | TAGTGA | GAGTGAGGA | X | X | X |
| 3 | 3 | 0 | ATCAACTTC | TTCAGG | GAGTGAGGA | X | X | X |
| 3 | 3 | 0 | AGCATGGTG | ATTAA | GAGTGAGGA | X | X | X |
| 4 | 3 | 1 | AGTAGTCTC | TGGCT | GAGTGAGGT | X | X | X |
| 4 | 3 | 1 | AGCATTGTT | TCTCA | GAGTGAGGT | X | X | X |
| 4 | 3 | 1 | AGCAAGGTT | AGGCT | GAGTGAGGG | X | X | X |
| 4 | 3 | 1 | AGCAGTCTT | CCACCA | GAGTGAGGC | X | X | X |

| # of mutations T (−) (+) (−) | site | spacer | (+) site | VF2468 concentration 4 nM | 2 nM | 10.5 nM |
|---|---|---|---|---|---|---|
| 4 3 1 | AGCATTGTT | TGAGT | GAGTGAGGT | X | X | X |
| 2 0 2 | AGCAGCGTC | CGCAGC | AAGTTAGGA | X | X | |
| 2 0 2 | AGCAGCGTC | ACTACA | GAGGCAGGA | X | X | |
| 2 1 1 | GGCAGCGTC | TCTCTG | GGGTGAGGA | X | X | |
| 2 1 1 | AGCAGAGTC | TTGAA | GAGTGAGTA | X | X | |
| 2 1 1 | AGCAGCATC | TATGC | CAGTGAGGA | X | X | |
| 2 1 1 | AGCAGAGTC | TGGCA | GAGAGAGGA | X | X | |
| 2 1 1 | AGCAGTGTC | CCTCA | GAGTGTGGA | X | X | |
| 2 1 1 | AGCAGCATC | TTGGA | GTGTGAGGA | X | X | |
| 2 1 1 | AGCTGCGTC | TTCTG | GAGGGAGGA | X | X | |
| 2 1 1 | AGCAGCTTC | AGAAGA | GAATGAGGA | X | X | |
| 2 1 1 | AGCAGGGTC | GAGGG | GAGGGAGGA | X | X | |
| 2 1 1 | AGCAGGGTC | TGGTG | CAGTGAGGA | X | X | |
| 2 1 1 | AGCAGCATC | CATGT | CAGTGAGGA | X | X | |
| 2 1 1 | AGCAGAGTC | CCAAG | GGGTGAGGA | X | X | |
| 2 1 1 | AGCAGCCTC | TGAAC | AAGTGAGGA | X | X | |
| 2 1 1 | AGCAGCCTC | TAGGT | AAGTGAGGA | X | X | |
| 2 1 1 | AGCAGCTTC | AGATTT | GAGTTAGGA | X | X | |
| 2 1 1 | AGCAGCCTC | ACAGG | CAGTGAGGA | X | X | |
| 2 1 1 | AGCAGCATC | AACAC | CAGTGAGGA | X | X | |
| 2 1 1 | AGCAGCGTG | TCAGCT | GTGTGAGGA | X | X | |
| 2 1 1 | AGCAGCATC | TATGC | CAGTGAGGA | X | X | |
| 2 1 1 | AGCAGCATC | AATAAT | AAGTGAGGA | X | X | |
| 2 1 1 | AGCAGAGTC | ACACA | GTGTGAGGA | X | X | |
| 2 1 1 | GGCAGCGTC | TGGGAG | GAGTTAGGA | X | X | |
| 2 1 1 | AGCAGCGCC | ATCTT | GAGCGAGGA | X | X | |
| 2 1 1 | AGCTGCGTC | GTGAG | AAGTGAGGA | X | X | |
| 2 1 1 | AGCAGGGTC | ACACA | GGGTGAGGA | X | X | |
| 2 1 1 | AGCAGAGTC | AGAGAG | GAGAGAGGA | X | X | |
| 2 1 1 | AGCAGAGTC | ACTGAC | CAGTGAGGA | X | X | |
| 2 1 1 | AGCAGTGTC | TCCCA | GAGTGTGGA | X | X | |
| 2 1 1 | AGCAGTGTC | TGAGTA | GAGTGTGGA | X | X | |
| 2 1 1 | AGCAGCATC | CCGGG | GAGTGAAGA | X | X | |
| 2 1 1 | AACAGCGTC | AAGGCA | GAGTGAAGA | X | X | |
| 2 1 1 | AGCAGCGCC | ATCTT | GAGCGAGGA | X | X | |
| 2 1 1 | AGCAGCGCC | ATCTT | GAGCGAGGA | X | X | |
| 2 1 1 | AGCAGCGCC | ATCTT | GAGCGAGGA | X | X | |
| 2 1 1 | AGCAGCGCC | ATCTT | GAGCGAGGA | X | X | |
| 2 1 1 | AGCAGCGCC | ATCTT | GAGCGAGGA | X | X | |
| 2 1 1 | AGCAGCGCC | ATCTT | GAGCGAGGA | X | X | |
| 2 1 1 | AGCAGCGCC | ATCTT | GAGCGAGGA | X | X | |
| 2 1 1 | AGCAGCATC | CATGT | CAGTGAGGA | X | X | |
| 2 1 1 | AGCAGAGTC | AGGGAG | GAGTGAAGA | X | X | |
| 2 1 1 | AGCAGCCTC | ATGGTC | AAGTGAGGA | X | X | |
| 2 1 1 | AGCAGCATC | GTGAGT | GAGTGTGGA | X | X | |
| 2 1 1 | AGCAGTGTC | TAGCAC | GAATGAGGA | X | X | |
| 2 1 1 | AGCAGAGTC | ACAGAA | GAGAGAGGA | X | X | |
| 2 1 1 | AGCAGCGTG | GTTAA | GAGTCAGGA | X | X | |
| 2 1 1 | ACCAGCGTC | TGGTGA | GAGTGGGGA | X | X | |
| 2 1 1 | AGCAGTGTC | TTGCT | GAGAGAGGA | X | X | |
| 2 1 1 | AGCAGCGAC | CTGGGC | GAGTGAGAA | X | X | |
| 2 1 1 | AGCAGTGTC | TGCCGT | GAGTGGGGA | X | X | |
| 2 1 1 | AGCAGCGTA | ATACA | CAGTGAGGA | X | X | |
| 2 1 1 | AGCAGCCTC | TAGAGA | AAGTGAGGA | X | X | |
| 2 1 1 | AGCAGAGTC | ACGGGT | GTGTGAGGA | X | X | |
| 2 1 1 | TGCAGCGTC | ATCAA | GAGTGTGGA | X | X | |
| 2 2 0 | AGCAGGGAC | CAGGTG | GAGTGAGGA | X | X | |
| 2 2 0 | AGCAGGCTC | TAAAAT | GAGTGAGGA | X | X | |
| 2 2 0 | AGCAGCCTA | GGAAT | GAGTGAGGA | X | X | |
| 2 2 0 | AGCATCCTC | CAGGAG | GAGTGAGGA | X | X | |
| 2 2 0 | AGCAGAGTA | CTCAGT | GAGTGAGGA | X | X | |
| 2 2 0 | AGCAGGGTA | GAAGA | GAGTGAGGA | X | X | |
| 2 2 0 | AGCAGAGAC | CTGAGG | GAGTGAGGA | X | X | |
| 2 2 0 | AGCAGAGTG | GGCAA | GAGTGAGGA | X | X | |
| 2 2 0 | AGCTGCCTC | GGTGGG | GAGTGAGGA | X | X | |
| 2 2 0 | AGGAGGGTC | CTGGAT | GAGTGAGGA | X | X | |
| 2 2 0 | AGCAGACTC | CTTGAT | GAGTGAGGA | X | X | |
| 2 2 0 | AGCAGAGTA | TTTGG | GAGTGAGGA | X | X | |
| 2 2 0 | AGCAGAGTT | GCCAG | GAGTGAGGA | X | X | |
| 2 2 0 | AGCAGCACC | AAAATG | GAGTGAGGA | X | X | |

| # of mutations T (−) (+) (−) | site | spacer | (+) site | VF2468 concentration 4 nM | 2 nM | 10.5 nM |
|---|---|---|---|---|---|---|
| 2 2 0 | AGCAGGATC | AGGTTA | GAGTGAGGA | X | X | |
| 2 2 0 | TGCAGCATC | CTTCAG | GAGTGAGGA | X | X | |
| 2 2 0 | AGCAGAGTG | TGGTG | GAGTGAGGA | X | X | |
| 2 2 0 | AGCAGTGCC | TACCA | GAGTGAGGA | X | X | |
| 2 2 0 | AGCAGAGTA | CCCAT | GAGTGAGGA | X | X | |
| 2 2 0 | AGCAGAGTG | AAAGGA | GAGTGAGGA | X | X | |
| 2 2 0 | AGCAGGATC | AAGAAA | GAGTGAGGA | X | X | |
| 2 2 0 | AGCAGCTTG | TGTCAT | GAGTGAGGA | X | X | |
| 2 2 0 | AGCAGAGTA | GGTTGT | GAGTGAGGA | X | X | |
| 3 0 3 | AGCAGCGTC | TGCAGT | TTGTGGGA | X | X | |
| 3 0 3 | AGCAGCGTC | AGGGGA | TTGTGGGA | X | X | |
| 3 0 3 | AGCAGCGTC | CAAGA | GAGTTACAA | X | X | |
| 3 0 3 | AGCAGCGTC | AAAGT | TTGAGAGGA | X | X | |
| 3 0 3 | AGCAGCGTC | AGGCTT | CAGTGTGAA | X | X | |
| 3 0 3 | AGCAGCGTC | AGGCTT | CAGTGTGAA | X | X | |
| 3 0 3 | AGCAGCGTC | TTTTT | GAGAGAAGG | X | X | |
| 3 0 3 | AGCAGCGTC | GGGGA | GAGTTGGGG | X | X | |
| 3 0 3 | AGCAGCGTC | TCCAG | GAACGTGGA | X | X | |
| 3 0 3 | AGCAGCGTC | CTTGGG | GAGTTTGGG | X | X | |
| 3 0 3 | AGCAGCGTC | GTCAC | AGGGGAGGA | X | X | |
| 3 0 3 | AGCAGCGTC | CAAAA | GGCTGAGGG | X | X | |
| 3 0 3 | AGCAGCGTC | CGTCG | CAGTGGGGC | X | X | |
| 3 0 3 | AGCAGCGTC | CGCACT | GAGGGGGCA | X | X | |
| 3 0 3 | AGCAGCGTC | TCTGC | GGGAGAGGC | X | X | |
| 3 0 3 | AGCAGCGTC | ATCTT | GAGTGGAGC | X | X | |
| 3 0 3 | AGCAGCGTC | AGCGA | CAGAGAGGC | X | X | |
| 3 0 3 | AGCAGCGTC | TGTAT | GTGTCAGAA | X | X | |
| 3 0 3 | AGCAGCGTC | ATTAGG | GCATGAGCA | X | X | |
| 3 0 3 | AGCAGCGTC | GATGGA | AAGGGAAGA | X | X | |
| 3 0 3 | AGCAGCGTC | AGGAA | GAGTTGTGA | X | X | |
| 3 0 3 | AGCAGCGTC | TACCGT | GAGTGCTCA | X | X | |
| 3 0 3 | AGCAGCGTC | AGGGT | TTGAGAGGA | X | X | |
| 3 0 3 | AGCAGCGTC | ATGAGT | GTGTAATGA | X | X | |
| 3 0 3 | AGCAGCGTC | TCTTTA | GAGTGGGTT | X | X | |
| 3 0 3 | AGCAGCGTC | CTGTG | GAGGCAGAA | X | X | |
| 3 0 3 | AGCAGCGTC | AGGCTT | CAGTGTGAA | X | X | |
| 3 0 3 | AGCAGCGTC | AGGCTT | CAGTGTGAA | X | X | |
| 3 0 3 | AGCAGCGTC | AGGCTT | CAGTGTGAA | X | X | |
| 3 0 3 | AGCAGCGTC | AGGCTT | CAGTGTGAA | X | X | |
| 3 0 3 | AGCAGCGTC | AGGCTT | CAGTGTGAA | X | X | |
| 3 0 3 | AGCAGCGTC | AGGCTT | CAGTGTGAA | X | X | |
| 3 0 3 | AGCAGCGTC | AGGGT | TTGAGAGGA | X | X | |
| 3 0 3 | AGCAGCGTC | ACACTC | TACTGAGGT | X | X | |
| 3 0 3 | AGCAGCGTC | ACATGC | CAGCGAGGT | X | X | |
| 3 0 3 | AGCAGCGTC | CATGGT | GACAGAGGT | X | X | |
| 3 0 3 | AGCAGCGTC | TTCCCT | GAGAGAGCT | X | X | |
| 3 0 3 | AGCAGCGTC | CAGGA | GAGGAAGGC | X | X | |
| 3 0 3 | AGCAGCGTC | ATACA | GGCTGAGGT | X | X | |
| 3 0 3 | AGCAGCGTC | TGCAT | GAAGGAGGT | X | X | |
| 3 0 3 | AGCAGCGTC | CCAGT | GAGCGATGG | X | X | |
| 3 0 3 | AGCAGCGTC | TTGCA | AAGGGAGAA | X | X | |
| 3 0 3 | AGCAGCGTC | AGGGT | TTGAGAGGA | X | X | |
| 3 0 3 | AGCAGCGTC | CACGT | GTGTGCGGT | X | X | |
| 3 0 3 | AGCAGCGTC | AGCCTC | TAGAGGGGA | X | X | |
| 3 0 3 | AGCAGCGTC | CGCAG | GAGGTAGGG | X | X | |
| 3 0 3 | AGCAGCGTC | CAAGA | GTGTTACGA | X | X | |
| 3 0 3 | AGCAGCGTC | CTAGC | CTGTGAGGG | X | X | |
| 3 0 3 | AGCAGCGTC | CTCCTG | GAGGGAGAG | X | X | |
| 3 0 3 | AGCAGCGTC | AGGGAG | GAGGGGAGA | X | X | |
| 3 0 3 | AGCAGCGTC | CCCCCG | CAGTGATGG | X | X | |
| 3 0 3 | AGCAGCGTC | TCCTGA | GAGAGAAGG | X | X | |
| 3 0 3 | AGCAGCGTC | TGTCCT | GAGTCCAGA | X | X | |
| 3 0 3 | AGCAGCGTC | AAGGAT | TAGAGAGTA | X | X | |
| 3 0 3 | AGCAGCGTC | TCCTGA | GAGAGAAGG | X | X | |
| 3 1 2 | AGTAGCGTC | CTAAT | GAGTGTGAA | X | X | |
| 3 1 2 | AGCAGCTTC | TCCATG | GAGTGAGAC | X | X | |
| 3 1 2 | AGCAGGGTC | GGGGA | GAGGGAGGG | X | X | |
| 3 1 2 | AGCAGCATC | CAGACT | CAGTGAGGT | X | X | |
| 3 1 2 | AGCAGGGTC | AGCTAA | GAGGGAGGC | X | X | |
| 3 1 2 | AGCAGCGGC | AGCGA | GAGTGATGT | X | X | |

| # of mutations | | | | | | VF2468 concentration | | |
|---|---|---|---|---|---|---|---|---|
| T | (−) | (+) | (−) site | spacer | (+) site | 4 nM | 2 nM | 10.5 nM |
| 3 | 1 | 2 | GGCAGCGTC | TGACG | GAGTGAGTG | X | X | |
| 3 | 1 | 2 | AGCAGTGTC | AGGTAG | GAGAGAGGC | X | X | |
| 3 | 1 | 2 | AGCAGGGTC | TGAGTG | GAGTAAGGT | X | X | |
| 3 | 1 | 2 | AGCAGTGTC | AGCTGG | TAGTGAGAA | X | X | |
| 3 | 1 | 2 | AGCACCGTC | TGGGG | GAGGGAAGA | X | X | |
| 3 | 1 | 2 | AGCAGCATC | AGCATG | GAGGGAGGC | X | X | |
| 3 | 1 | 2 | AGCAGCCTC | GGTCAA | GAGTGAGAG | X | X | |
| 3 | 1 | 2 | GGCAGCGTC | AATAA | AAGTGAGGG | X | X | |
| 3 | 1 | 2 | AGCAACGTC | GGCAG | CAGTGGGGA | X | X | |
| 3 | 1 | 2 | AGCAACGTC | AGCAAA | GTCTGAGGA | X | X | |
| 3 | 1 | 2 | AGCAGGGTC | AGTGTC | TAGTGAGAA | X | X | |
| 3 | 1 | 2 | AGCAGGGTC | AGGATG | GAGTGGGGT | X | X | |
| 3 | 1 | 2 | AGCAGTGTC | AGTGAA | CAGTGAGGT | X | X | |
| 3 | 1 | 2 | AGCAGGGTC | AGTGCC | TAGTGAGGG | X | X | |
| 3 | 1 | 2 | AGCAGCGTA | CGGACT | GAGTGAGCC | X | X | |
| 3 | 1 | 2 | AGCAGCTTC | CCCAGT | AAGTGAGAA | X | X | |
| 3 | 1 | 2 | AGCAGCGGC | ACCTC | GAGAGAGAA | X | X | |
| 3 | 1 | 2 | AGCAGTGTC | CTCAC | CAGTAAGGA | X | X | |
| 3 | 1 | 2 | AGCAGGGTC | TGTTA | GAGTGAGTG | X | X | |
| 3 | 1 | 2 | AGCAGCTTC | ACCTG | GAGGGAGGG | X | X | |
| 3 | 1 | 2 | AGCACCGTC | ATCTAA | GGGTGAGGC | X | X | |
| 3 | 1 | 2 | AGCATCGTC | CTGTG | GAGCGAGGG | X | X | |
| 3 | 1 | 2 | AGCAGGGTC | CTTACT | CAGTGAGGT | X | X | |
| 3 | 1 | 2 | AGCAGAGTC | TGAGA | GTGTGAGGT | X | X | |
| 3 | 1 | 2 | AGCAGCGTG | CAGTGA | CAGTGAGGC | X | X | |
| 3 | 1 | 2 | AGCACCGTC | ATTGGA | GAGGGAGAA | X | X | |
| 3 | 1 | 2 | AGCAGCTTC | ACCTG | GAGGGAGGG | X | X | |
| 3 | 1 | 2 | AGCAGAGTC | GCTGCA | GAGTGAGCC | X | X | |
| 3 | 1 | 2 | AGCAGCTTC | ACCTG | GAGGGAGGG | X | X | |
| 3 | 1 | 2 | AGCAGCTTC | ACCTG | GAGGGAGGG | X | X | |
| 3 | 1 | 2 | AGCAGCTTC | ACCTG | GAGGGAGGG | X | X | |
| 3 | 1 | 2 | AGCAGCTTC | ACCTG | GAGGGAGGG | X | X | |
| 3 | 1 | 2 | AGCAGCTTC | ACCTG | GAGGGAGGG | X | X | |
| 3 | 1 | 2 | AGCAGAGTC | CTTGG | GAGGGAGGG | X | X | |
| 3 | 1 | 2 | AGCAGCTTC | ACCTG | GAGGGAGGG | X | X | |
| 3 | 1 | 2 | AGCAGCGTA | TGCATA | CAGTGAGGG | X | X | |
| 3 | 1 | 2 | AGCAGTGTC | AGGCTG | GTGTGAGAA | X | X | |
| 3 | 1 | 2 | AGCAGAGTC | GGCGTC | TAGTGAGGG | X | X | |
| 3 | 1 | 2 | AGCAGCGTG | GGCCGG | GAGGGAGGT | X | X | |
| 3 | 1 | 2 | GGCAGCGTC | CGATT | CAGTGAGGG | X | X | |
| 3 | 1 | 2 | AGCAGCTTC | ACTGAA | GAGGGAGGC | X | X | |
| 3 | 1 | 2 | ATCAGCGTC | TCTGG | GAGTGGGGC | X | X | |
| 3 | 1 | 2 | AGCAGCGGC | AGGCGA | GAGTGACAA | X | X | |
| 3 | 1 | 2 | AGCAGCTTC | AACGT | GAGTGATGT | X | X | |
| 3 | 1 | 2 | AGCAGCTTC | CTGGG | GAGTGAGTT | X | X | |
| 3 | 1 | 2 | AGCAGCATC | TCGTG | GAGGGAGGC | X | X | |
| 3 | 1 | 2 | AGCAGAGTC | TTCAG | GAGAGAGGC | X | X | |
| 3 | 1 | 2 | AGCAGGGTC | AAGTTC | CAGTGAGGG | X | X | |
| 3 | 1 | 2 | AGCAGAGTC | AGTCTT | GAGTGAGTT | X | X | |
| 3 | 1 | 2 | AGCAGAGTC | AGACTT | GAGTGAGTT | X | X | |
| 3 | 1 | 2 | TGCAGCGTC | CAGAT | GAGGGAGGT | X | X | |
| 3 | 1 | 2 | AGCATCGTC | AGAAT | GGGTGAGGG | X | X | |
| 3 | 1 | 2 | AGCAGTGTC | CAGCTC | CAGTGAGGC | X | X | |
| 3 | 1 | 2 | AGCAGCTTC | TAAAAG | GAGAGAGGT | X | X | |
| 3 | 1 | 2 | AGCAGGGTC | CATGAG | GAGTGAGCC | X | X | |
| 3 | 1 | 2 | AGCAGTGTC | ACCACA | GAGTGAAGG | X | X | |
| 3 | 1 | 2 | AGCAGGGTC | AGGTTT | TAGTGAGGG | X | X | |
| 3 | 1 | 2 | AGCAGCATC | AATGTC | TAGTGAGGG | X | X | |
| 3 | 1 | 2 | AGCAGTGTC | CCGCAC | GAGGAAGGA | X | X | |
| 3 | 1 | 2 | AGCAGCTTC | TTGTGA | GAGAGAGGT | X | X | |
| 3 | 1 | 2 | AGCAGAGTC | CTAAGC | GGGTGAGGG | X | X | |
| 3 | 1 | 2 | AGCAGTGTC | AAGTA | GAGTGAAGG | X | X | |
| 3 | 1 | 2 | AGCATCGTC | AAGTTC | TGGTGAGGA | X | X | |
| 3 | 1 | 2 | AGCAGGGTC | CCTGCT | GAGAGAGGG | X | X | |
| 3 | 1 | 2 | AGCAGAGTC | AAGTCA | GAGAGAGGC | X | X | |
| 3 | 1 | 2 | AGCAGCGGC | TGATG | GACTGAGGC | X | X | |
| 3 | 1 | 2 | AGCAGAGTC | CAGTGG | GTGTGAGGC | X | X | |
| 3 | 1 | 2 | AGCAGCGGC | TGATG | GACTGAGGC | X | X | |
| 3 | 1 | 2 | AGCAGCGGC | AGCCGA | GAGAGAGGG | X | X | |
| 3 | 1 | 2 | AGCAGCGGC | TGATG | GACTGAGGC | X | X | |

| # of mutations | | | | | | VF2468 concentration | | |
|---|---|---|---|---|---|---|---|---|
| T (−) | (+) | (−) site | spacer | (+) site | | 4 nM | 2 nM | 10.5 nM |
| 3 | 1 | 2 AGCAGCGGC | TGATG | GACTGAGGC | | X | X | |
| 3 | 1 | 2 AGCAGCGGC | TGATG | GACTGAGGC | | X | X | |
| 3 | 1 | 2 AGCAGCGGC | TGATG | GACTGAGGC | | X | X | |
| 3 | 1 | 2 AGCAGCGGC | TGATG | GACTGAGGC | | X | X | |
| 3 | 1 | 2 AGCAGCGGC | AGCCGA | GAGAGAGGG | | X | X | |
| 3 | 1 | 2 AGCAGCGGC | TGATG | GACTGAGGC | | X | X | |
| 3 | 1 | 2 TGCAGCGTC | TTGTT | TAGTGAGGC | | X | X | |
| 3 | 1 | 2 AGCAGTGTC | AGGCTG | GTGTGAGAA | | X | X | |
| 3 | 1 | 2 AGCAGCGTA | GAGTGG | GAATGAGGG | | X | X | |
| 3 | 1 | 2 AGCATCGTC | ACAGGA | GGGTGAGGT | | X | X | |
| 3 | 1 | 2 AGCAGCGGC | ACCCA | GAATGAGGG | | X | X | |
| 3 | 1 | 2 AGCAGCGTT | ATTTCA | GAGTGTGGT | | X | X | |
| 3 | 1 | 2 AGCAGAGTC | GCTCCA | GAGTGAGCC | | X | X | |
| 3 | 1 | 2 AGCAGTGTC | ATCTTT | GAGTGGGAA | | X | X | |
| 3 | 1 | 2 AGCAGCATC | TCCTAG | CAGTGAGGG | | X | X | |
| 3 | 1 | 2 AGCAACGTC | AGTGG | GACTGAGGG | | X | X | |
| 3 | 1 | 2 AGCACCGTC | ATCTT | GAGTGAGCT | | X | X | |
| 3 | 1 | 2 AGCAGGGTC | CTGAG | GGGAGAGGA | | X | X | |
| 3 | 1 | 2 GGCAGCGTC | AGGAGA | GAGTGATGT | | X | X | |
| 3 | 1 | 2 AGCATCGTC | GGGGAG | GAGTGGGAA | | X | X | |
| 3 | 1 | 2 AGCAGTGTC | TGTGCT | CAGTGAGGT | | X | X | |
| 3 | 1 | 2 AGCAGTGTC | AGTCCT | GAGAGAGCA | | X | X | |
| 3 | 1 | 2 AGCAGCGTT | GCTTTC | TAGTGAGGT | | X | X | |
| 3 | 1 | 2 AGCAGCGGC | GACAGG | GAGAGAGGG | | X | X | |
| 3 | 1 | 2 AGCACCGTC | CTGAAA | CAGTGAGTA | | X | X | |
| 3 | 1 | 2 AGCAGTGTC | TGCTGG | GAGGGTGGA | | X | X | |
| 3 | 1 | 2 AGCAGCGCC | CTGTGG | GAGGGAGGT | | X | X | |
| 3 | 1 | 2 AGCAGAGTC | AGAAA | GAGTAAGGC | | X | X | |
| 3 | 1 | 2 AGCAGCTTC | TCTAAG | GAGTGGGGG | | X | X | |
| 3 | 1 | 2 AGCAGCTTC | ACCTG | GAGGGAGGG | | X | X | |
| 3 | 1 | 2 AGCAGCTTC | ACCTG | GAGGGAGGG | | X | X | |
| 3 | 1 | 2 AGCAGCTTC | ACCTG | GAGGGAGGG | | X | X | |
| 3 | 1 | 2 AGCAGCTTC | ATCTG | GAGGGAGGG | | X | X | |
| 3 | 1 | 2 AGCAGCTTC | ACCTG | GAGGGAGGG | | X | X | |
| 3 | 1 | 2 AGCAGCTTC | ACCTG | GAGGGAGGG | | X | X | |
| 3 | 1 | 2 AGCAGCTTC | ACCTG | GAGGGAGGG | | X | X | |
| 3 | 1 | 2 AGCAGCTTC | ACCTG | GAGGGAGGG | | X | X | |
| 3 | 1 | 2 AGCAGCTTC | ACCTG | GAGGGAGGG | | X | X | |
| 3 | 1 | 2 AGCAGCTTC | ACCTG | GAGGGAGGG | | X | X | |
| 3 | 1 | 2 AGCAGCTTC | CTGCTC | CAGTGAGGG | | X | X | |
| 3 | 1 | 2 AGCAGCTTC | ACCTG | GAGGGAGGG | | X | X | |
| 3 | 1 | 2 AGCAGAGTC | AAGAGG | GTGTGAGGG | | X | X | |
| 3 | 1 | 2 AGCAGGGTC | CTGAAG | GAGGGAGGG | | X | X | |
| 3 | 1 | 2 AGCAGGGTC | AGCCCA | GAGGGAGGC | | X | X | |
| 3 | 1 | 2 GGCAGCGTC | ATTTT | GAGTGGGGG | | X | X | |
| 3 | 1 | 2 AGCAGCGTG | TGGCA | GAGAGAGGG | | X | X | |
| 3 | 1 | 2 AGCACCGTC | CCCGAG | GTGGGAGGA | | X | X | |
| 3 | 1 | 2 AGCAGCTTC | CCATC | GGGTGAGGG | | X | X | |
| 3 | 1 | 2 AGCAGCATC | TGTGGA | CAGTGAGGT | | X | X | |
| 3 | 1 | 2 AGCAGCGTG | CTGGAT | GAGTGTGGT | | X | X | |
| 3 | 1 | 2 AGCAGCGGC | AGGCAC | CAGTGAGGG | | X | X | |
| 3 | 1 | 2 AGCAGGGTC | AGGGGT | GAGTGGGGT | | X | X | |
| 3 | 1 | 2 AGCAGCGGC | GAACA | GAGCGGGGA | | X | X | |
| 3 | 1 | 2 AGCTGCGTC | TCTGGG | AAGTGAGGG | | X | X | |
| 3 | 1 | 2 AGCAGGGTC | ATGACA | GAGAGAGGG | | X | X | |
| 3 | 1 | 2 AGCAGCATC | TGGCA | GAGTAAGGG | | X | X | |
| 3 | 1 | 2 AGCAGTGTC | CACCT | GAGTTAGGT | | X | X | |
| 3 | 1 | 2 AGCAGCGAC | GGCGG | GTGTGAGGC | | X | X | |
| 3 | 1 | 2 AGCAGGGTC | ACACTA | AAGTGAGGC | | X | X | |
| 3 | 2 | 1 AGCTGTGTC | ATGAC | AAGTGAGGA | | X | X | |
| 3 | 2 | 1 AGCTGGGTC | ATGTG | AAGTGAGGA | | X | X | |
| 3 | 2 | 1 AGCTGGGTC | ATGTG | AAGTGAGGA | | X | X | |
| 3 | 2 | 1 GGCAGCGGC | CGGAAA | AAGTGAGGA | | X | X | |
| 3 | 2 | 1 AGCATGGTC | AATGA | CAGTGAGGA | | X | X | |
| 3 | 2 | 1 ATCAGCCTC | TTGTAG | GAGTGAGGG | | X | X | |
| 3 | 2 | 1 AGCATGGTC | ATGAA | CAGTGAGGA | | X | X | |
| 3 | 2 | 1 AGCAGGGGC | ATGAGA | GAGTGAGGT | | X | X | |
| 3 | 2 | 1 AACAGCGTG | GCGGA | GAGTGAGGG | | X | X | |
| 3 | 2 | 1 AACAGAGTC | CAGGAA | GAGTGAGGT | | X | X | |
| 3 | 2 | 1 AACAGCATC | AGCTCT | GAGTGAGGC | | X | X | |

| # of mutations | | | (−) site | spacer | (+) site | VF2468 concentration | | |
|---|---|---|---|---|---|---|---|---|
| T (−) | (+) | (−) | | | | 4 nM | 2 nM | 10.5 nM |
| 3 | 2 | 1 | ATCAGTGTC | AGTGAG | CAGTGAGGA | X | X | |
| 3 | 2 | 1 | AGCAGCTGC | ATGAT | GAGTGAGGT | X | X | |
| 3 | 2 | 1 | AGCAGGGTT | GATCA | GAGGGAGGA | X | X | |
| 3 | 2 | 1 | AGCATAGTC | CAGAT | TAGTGAGGA | X | X | |
| 3 | 2 | 1 | AGCAGCAAC | CTTAA | GAGTGAGGG | X | X | |
| 3 | 2 | 1 | AGCTACGTC | TAAGG | GAGAGAGGA | X | X | |
| 3 | 2 | 1 | AGCAGCATT | GGTCCT | GAGTGAGGT | X | X | |
| 3 | 2 | 1 | AGCATTGTC | ATGAA | GAGGGAGGA | X | X | |
| 3 | 2 | 1 | AGCAGCACC | TGGCCT | GAGTGAGGG | X | X | |
| 3 | 2 | 1 | AGCAGGGTT | GGGCA | GAGGGAGGA | X | X | |
| 3 | 2 | 1 | AGTAGAGTC | TGACTA | AAGTGAGGA | X | X | |
| 3 | 2 | 1 | AGCAACGTG | AGTGT | GAGCGAGGA | X | X | |
| 3 | 2 | 1 | AGCAAGGTC | CCACT | CAGTGAGGA | X | X | |
| 3 | 2 | 1 | AGCAGCCAC | AAGGT | GAGTGAGGG | X | X | |
| 3 | 2 | 1 | AGCAATGTC | AGGGA | AAGTGAGGA | X | X | |
| 3 | 2 | 1 | AGCAGCTAC | TCCAGA | GAGTGAGGT | X | X | |
| 3 | 2 | 1 | AGCAGCTGC | AGCAG | GGGTGAGGA | X | X | |
| 3 | 2 | 1 | AGCAGGGGC | AGCAT | GAGTGAGGT | X | X | |
| 3 | 2 | 1 | AGCAACGTG | ACCTAC | TAGTGAGGA | X | X | |
| 3 | 2 | 1 | AACAGCGTA | AGTAC | AAGTGAGGA | X | X | |
| 3 | 2 | 1 | TGCACCGTC | AGTAA | CAGTGAGGA | X | X | |
| 3 | 2 | 1 | AGCAGTGTG | TCCCAA | GAGTGAGGG | X | X | |
| 3 | 2 | 1 | AGCAGCTGC | AATTAT | GAGAGAGGA | X | X | |
| 3 | 2 | 1 | AGCACCTTC | TAGCTA | GAGTGAGCA | X | X | |
| 3 | 2 | 1 | AGCAAGGTC | AGAAG | GAGTAAGGA | X | X | |
| 3 | 2 | 1 | AGCTGCGTG | GGAGCA | GAGTGAGGC | X | X | |
| 3 | 2 | 1 | AGCAAGGTC | CTAGT | GAGTGAAGA | X | X | |
| 3 | 2 | 1 | AGCAGATTC | AGAAG | GAGTGAGGG | X | X | |
| 3 | 2 | 1 | AGCAAAGTC | ATTAGA | GAGTAAGGA | X | X | |
| 3 | 2 | 1 | TGCAGGGTC | TTCCC | GAGTGAGGG | X | X | |
| 3 | 2 | 1 | AGCAGAATC | TTCTGG | GAGTGAGGT | X | X | |
| 3 | 2 | 1 | AGCTGAGTC | CCTAGA | GAGGGAGGA | X | X | |
| 3 | 2 | 1 | AGCATTGTC | CAGAAA | CAGTGAGGA | X | X | |
| 3 | 2 | 1 | TGCAGGGTC | CCAGC | GAGTGAGGG | X | X | |
| 3 | 2 | 1 | AGCAACTTC | ATGTAT | GAGTGTGGA | X | X | |
| 3 | 2 | 1 | AGCAGCTGC | CTGCTG | GAGTGAGGG | X | X | |
| 3 | 2 | 1 | AGCAGGGTT | GGGGA | GAGGGAGGA | X | X | |
| 3 | 2 | 1 | AGCAAGGTC | ACTGA | GAGTAAGGA | X | X | |
| 3 | 2 | 1 | AGCTGTGTC | AAAGG | AAGTGAGGA | X | X | |
| 3 | 2 | 1 | AACAGCATC | TTAGGG | GAGTGAGGG | X | X | |
| 3 | 2 | 1 | AGAAGCTTC | TAGGCT | GAGTGAGGC | X | X | |
| 3 | 2 | 1 | AGCAGAGTT | TGGGGT | GAGTGAGAA | X | X | |
| 3 | 2 | 1 | AGCAGAGTT | TGCTTT | GAGTGAGTA | X | X | |
| 3 | 2 | 1 | AGGAGGGTC | TGAAGA | GAGTGAGGG | X | X | |
| 3 | 2 | 1 | AGCAACTTC | AGCAAA | GTGTGAGGA | X | X | |
| 3 | 2 | 1 | AGCAGCTCC | CTGGA | GAGTGAGGG | X | X | |
| 3 | 2 | 1 | AGCAAAGTC | TGGGAG | AAGTGAGGA | X | X | |
| 3 | 2 | 1 | AGCAACGTG | ACCCCT | GAGTGGGGA | X | X | |
| 3 | 2 | 1 | AGCAGGGTG | TATAA | GAGTGAGGG | X | X | |
| 3 | 2 | 1 | AGCAGGTTC | TTGGGA | GAGTGAGGT | X | X | |
| 3 | 2 | 1 | AGCAGCTTG | TTTCT | GAGTGAGGG | X | X | |
| 3 | 2 | 1 | AGCAGTGTT | GCATTA | AAGTGAGGA | X | X | |
| 3 | 2 | 1 | AGAGGCGTC | TGAGCA | GAGTGAGGG | X | X | |
| 3 | 2 | 1 | AGCAGTGAC | TTAGGA | AAGTGAGGA | X | X | |
| 3 | 2 | 1 | AGCACCTTC | CGAGT | GAGTGAGCA | X | X | |
| 3 | 2 | 1 | ATCAGTGTC | TCCTC | CAGTGAGGA | X | X | |
| 3 | 2 | 1 | AGCAGCAGC | AGGAA | GAGTGAGGC | X | X | |
| 3 | 2 | 1 | AGCAGTGAC | ACCTG | AAGTGAGGA | X | X | |
| 3 | 2 | 1 | AGCAGGGTT | CACAGG | GAGGGAGGA | X | X | |
| 3 | 2 | 1 | AGCTGCGGC | AGGCCC | GAGTGAGGC | X | X | |
| 3 | 2 | 1 | AGCAACATC | TGCTA | CAGTGAGGA | X | X | |
| 3 | 2 | 1 | AGCAACGTA | TAATC | TAGTGAGGA | X | X | |
| 3 | 2 | 1 | AGCAGGATC | GCCTGT | GAGTGAGGG | X | X | |
| 3 | 2 | 1 | AGCAGCAAC | ATGGGA | GAGTGAGGT | X | X | |
| 3 | 2 | 1 | AGTAGCGGC | TTCACA | GAGTGAGAA | X | X | |
| 3 | 2 | 1 | AGCAGCCAC | ATCCT | GAGTGAGGG | X | X | |
| 3 | 2 | 1 | AGCAGCTGC | CAGAA | GAGAGAGGA | X | X | |
| 3 | 2 | 1 | AGCACCGTT | GTTAG | AAGTGAGGA | X | X | |
| 3 | 2 | 1 | AGCAGGGTG | GTTAA | GAGTGAGGG | X | X | |
| 3 | 2 | 1 | AGCTGGGTC | TTGGGA | AAGTGAGGA | X | X | |
| 3 | 2 | 1 | ACCACCGTC | GCGGA | AAGTGAGGA | X | X | |

| # of mutations | | | | | | VF2468 concentration | | |
|---|---|---|---|---|---|---|---|---|
| T (−) | (+) | (−) site | spacer | (+) site | | 4 nM | 2 nM | 10.5 nM |
| 3 | 2 | 1 AGAAGCTTC | AGTTG | GAGTGAGGT | | X | X | |
| 3 | 2 | 1 AGCAGAGGC | ACCTTT | GAGTGAGGT | | X | X | |
| 3 | 2 | 1 AGCATCGTT | GAGCT | CAGTGAGGA | | X | X | |
| 3 | 2 | 1 AGAAGCGTG | TGCTG | GAGTGAGGC | | X | X | |
| 3 | 2 | 1 GACAGCGTC | TGGGAG | GTGTGAGGA | | X | X | |
| 3 | 2 | 1 AGCAGAGAC | CTGCAT | GAGTGAGGG | | X | X | |
| 3 | 2 | 1 AGCAAAGTC | CTAAGG | AAGTGAGGA | | X | X | |
| 3 | 2 | 1 AGCATTGTC | TCTAGA | GAATGAGGA | | X | X | |
| 3 | 2 | 1 AGCAAAGTC | TTGAGA | GAGCGAGGA | | X | X | |
| 3 | 2 | 1 AGCACAGTC | CCCGTT | GAGAGAGGA | | X | X | |
| 3 | 2 | 1 AGCAGCAGC | ACTGA | GAGTGAGGC | | X | X | |
| 3 | 2 | 1 AGCAGGGTG | GGGTGT | GAGTGAGGT | | X | X | |
| 3 | 2 | 1 AGGAGCATC | GCGCAG | GAGTGAGGC | | X | X | |
| 3 | 2 | 1 AGCTGGGTC | ATGTG | AAGTGAGGA | | X | X | |
| 3 | 2 | 1 AGCTGTGTC | ATGAC | AAGTGAGGA | | X | X | |
| 3 | 2 | 1 AGCTGTGTC | ATGAC | AAGTGAGGA | | X | X | |
| 3 | 2 | 1 AGGAGCGTA | TCTTCT | GAGTGAGGC | | X | X | |
| 3 | 2 | 1 AGCAGCCAC | AGCCA | GAGTGAGGG | | X | X | |
| 3 | 2 | 1 AGCAGCATG | TGCAGG | GAGTGAGGC | | X | X | |
| 3 | 2 | 1 AGCATTGTC | TTTTGA | GAGTGAGAA | | X | X | |
| 3 | 2 | 1 AGCAGCCTG | GACGT | GAGTGAGGT | | X | X | |
| 3 | 2 | 1 AGCAGCTCC | AGCGA | GAGTGAGGG | | X | X | |
| 3 | 2 | 1 AGCAGCAGC | TAGGGA | GAGTGAGGC | | X | X | |
| 3 | 2 | 1 AGCAACTTC | AATCAG | GAGTGTGGA | | X | X | |
| 3 | 2 | 1 AGCAGAGTA | GCTTT | GAGTGAGGG | | X | X | |
| 3 | 2 | 1 AGCAGCCTT | GTGTG | GAGTGAGGT | | X | X | |
| 3 | 2 | 1 AGCAGTGTT | TCTGA | AAGTGAGGA | | X | X | |
| 3 | 2 | 1 AGAAGCATC | TGTAT | GAGTGAGGG | | X | X | |
| 3 | 2 | 1 AGCAGGGTA | AACAAA | GAGTGAGGT | | X | X | |
| 3 | 2 | 1 AGCAGAGTT | AGGAGA | GAGTGAGGG | | X | X | |
| 3 | 2 | 1 AGCAGAGGC | TGGGGA | GAGTGAGGG | | X | X | |
| 3 | 2 | 1 AGCAACATC | TTATA | GAGTGAGCA | | X | X | |
| 3 | 2 | 1 AGCAGAGTA | TGTCA | GAGTGAGGT | | X | X | |
| 3 | 2 | 1 AGCATCGTT | GAGCT | GAGTGAAGA | | X | X | |
| 3 | 2 | 1 AGAAGCTTC | CAGAAT | GAGTGAGGC | | X | X | |
| 3 | 2 | 1 ATCAGCGGC | AGATGG | CAGTGAGGA | | X | X | |
| 3 | 2 | 1 AGCAGAATC | TCTGG | GAGTGAGGC | | X | X | |
| 3 | 2 | 1 AGCTACGTC | ACCTT | GAGGGAGGA | | X | X | |
| 3 | 2 | 1 AGCAATGTC | AACAA | GAGTGAGAA | | X | X | |
| 3 | 2 | 1 AGCATTGTC | ATGGTG | GAGGGAGGA | | X | X | |
| 3 | 2 | 1 AGCACCGCC | GGGAA | AAGTGAGGA | | X | X | |
| 3 | 2 | 1 AGCACGGTC | GGGTAC | TAGTGAGGA | | X | X | |
| 3 | 2 | 1 AGCAACATC | TATAT | GAGTGAGCA | | X | X | |
| 3 | 2 | 1 AGCAGGGTT | GGAGT | GAGGGAGGA | | X | X | |
| 3 | 2 | 1 AGCAGCTGC | AGCACC | GAGTGAGGG | | X | X | |
| 3 | 2 | 1 AGCAGTGTG | TGGGAG | GAGTGAGGG | | X | X | |
| 3 | 2 | 1 AACAGAGTC | TGGTT | GAGTGAGGC | | X | X | |
| 3 | 2 | 1 GGCAGTGTC | TGGCA | AAGTGAGGA | | X | X | |
| 3 | 2 | 1 AGCAGTGTG | TGGGAG | GAGTGAGGG | | X | X | |
| 3 | 2 | 1 AGCAAGGTC | CAGACA | AAGTGAGGA | | X | X | |
| 3 | 2 | 1 AGCAGTGTG | TGGGAG | GAGTGAGGG | | X | X | |
| 3 | 2 | 1 AGCAGTGTG | TGGGAG | GAGTGAGGG | | X | X | |
| 3 | 2 | 1 AGCAGTGTG | TGGGAG | GAGTGAGGG | | X | X | |
| 3 | 2 | 1 AGCAGTGTG | TGGGAG | GAGTGAGGG | | X | X | |
| 3 | 2 | 1 AGCAGCATG | AGAGG | GAGTGAGGG | | X | X | |
| 3 | 2 | 1 AGCACTGTC | ATTAT | AAGTGAGGA | | X | X | |
| 3 | 2 | 1 GGCAGTGTC | TGGAAA | AAGTGAGGA | | X | X | |
| 3 | 2 | 1 CACAGCGTC | ATCCTG | GAGTGAGAA | | X | X | |
| 3 | 2 | 1 AGCACCTTC | CTGGCT | GAGTGAGGG | | X | X | |
| 3 | 2 | 1 AGCACAGTC | CCAAAT | GAGTGAGAA | | X | X | |
| 3 | 2 | 1 AGCAGATTC | TGGTA | GAGTGAGGG | | X | X | |
| 3 | 2 | 1 AGGAGGGTC | AGCCT | GAGTGAGGG | | X | X | |
| 3 | 2 | 1 AGCAACGTG | GCGGG | AAGTGAGGA | | X | X | |
| 3 | 2 | 1 AGCGGCGTT | GAGCTT | GAGTGAGGC | | X | X | |
| 3 | 2 | 1 AGGAGTGTC | TGGGT | GAGTGAGGT | | X | X | |
| 3 | 2 | 1 AGCTGCTTC | ACTGAT | GAGTGAGGC | | X | X | |
| 3 | 2 | 1 AGCAACATC | CACTG | CAGTGAGGA | | X | X | |
| 3 | 2 | 1 AGCATAGTC | GGACAA | TAGTGAGGA | | X | X | |
| 3 | 2 | 1 AGCAACATC | AAACCT | GAGAGAGGA | | X | X | |
| 3 | 2 | 1 GGCAGCGCC | CATCT | GAGTGAGGG | | X | X | |

| # of mutations | | | | | | VF2468 concentration | | |
|---|---|---|---|---|---|---|---|---|
| T (−) | (+) | (−) site | spacer | (+) site | | 4 nM | 2 nM | 10.5 nM |
| 3 | 2 | 1 AGCAGAGTG | TCCAA | GAGTGAGGG | | X | X | |
| 3 | 2 | 1 AGCAAAGTC | CTAGAT | GAGGGAGGA | | X | X | |
| 3 | 2 | 1 GACAGCGTC | ACACA | CAGTGAGGA | | X | X | |
| 3 | 2 | 1 AGCGGCGGC | TGGAT | GAGTGAGGG | | X | X | |
| 3 | 2 | 1 AGCCGCATC | ATCAA | GAGTGAGGC | | X | X | |
| 3 | 2 | 1 AGCAAAGTC | CCCAG | GAGGGAGGA | | X | X | |
| 3 | 2 | 1 AGCAGGTTC | TAAGA | GAGTGAGGT | | X | X | |
| 3 | 2 | 1 AGCTGGGTC | ACACG | AAGTGAGGA | | X | X | |
| 3 | 2 | 1 AGCAGAGAC | TGAATG | GAGTGAGGG | | X | X | |
| 3 | 2 | 1 AGCAGAGGC | TTAAAG | GAGTGAGGG | | X | X | |
| 3 | 2 | 1 AGCTGAGTC | TAGCCA | AAGTGAGGA | | X | X | |
| 3 | 2 | 1 AGTAGAGTC | TTCCA | GAGTGAGAA | | X | X | |
| 3 | 2 | 1 TGCAGCGAC | AACAG | GAGTGAGGT | | X | X | |
| 3 | 2 | 1 AGCAGCTGC | CTCCG | GAGAGAGGA | | X | X | |
| 3 | 2 | 1 AGCAGCATG | GCCCT | GAGTGAGGG | | X | X | |
| 3 | 2 | 1 AGCTGAGTC | CCAAA | GAGTGAGAA | | X | X | |
| 3 | 2 | 1 AGCAACATC | TGCTA | CAGTGAGGA | | X | X | |
| 3 | 2 | 1 AGCAACATC | TGCTA | CAGTGAGGA | | X | X | |
| 3 | 2 | 1 ACCAGCTTC | CTGCT | GAGTGAGGT | | X | X | |
| 3 | 2 | 1 AGCAGCATT | ATTCT | GAGTGAGGG | | X | X | |
| 3 | 2 | 1 AGGAGTGTC | GACAAG | GAGTGAGGG | | X | X | |
| 3 | 2 | 1 AGAAGCGGC | TGCAG | GAGTGAGGG | | X | X | |
| 3 | 2 | 1 AGCAGCCAC | AGACTA | GAGTGAGGC | | X | X | |
| 3 | 2 | 1 AGCAGCAGC | AGCAG | GAGTGAGGC | | X | X | |
| 3 | 2 | 1 AGCACAGTC | CGCAGG | GAGGGAGGA | | X | X | |
| 3 | 2 | 1 AGCTGCGGC | GAATGA | GAGTGAGGG | | X | X | |
| 3 | 2 | 1 AGCAAGGTC | TTATA | GGGTGAGGA | | X | X | |
| 3 | 2 | 1 AGCACCTTC | TCCAT | GAGTGGGGA | | X | X | |
| 3 | 2 | 1 AGCAGCATG | ATCCTG | GAGTGAGGC | | X | X | |
| 3 | 2 | 1 AGCAAGGTC | AAGAGA | GAGTGAGCA | | X | X | |
| 3 | 2 | 1 AGCATGGTC | AAAGCT | GAGTGAGAA | | X | X | |
| 3 | 2 | 1 AGCAGCATG | ATCTTG | GAGTGAGGC | | X | X | |
| 3 | 2 | 1 AGCAGGGTG | GGGTGT | GAGTGAGGT | | X | X | |
| 3 | 3 | 0 AGAGGTGTC | GCCAT | GAGTGAGGA | | X | X | |
| 3 | 3 | 0 GTCAGGGTC | ATCAG | GAGTGAGGA | | X | X | |
| 3 | 3 | 0 TGCACTGTC | TCTCCC | GAGTGAGGA | | X | X | |
| 3 | 3 | 0 TGCGGAGTC | GAGGGT | GAGTGAGGA | | X | X | |
| 3 | 3 | 0 AGAAACGTT | CTTGCT | GAGTGAGGA | | X | X | |
| 3 | 3 | 0 AGGAGCAAC | ATGCT | GAGTGAGGA | | X | X | |
| 3 | 3 | 0 CGCTGTGTC | CCCGGG | GAGTGAGGA | | X | X | |
| 3 | 3 | 0 AGCGTGGTC | ACTAGG | GAGTGAGGA | | X | X | |
| 3 | 3 | 0 AGCAGGTCC | TTGAA | GAGTGAGGA | | X | X | |
| 3 | 3 | 0 GGCTGTGTC | ATTCAG | GAGTGAGGA | | X | X | |
| 3 | 3 | 0 TGCAGAGTT | AGAGGT | GAGTGAGGA | | X | X | |
| 3 | 3 | 0 ATCATGGTC | AGAAAA | GAGTGAGGA | | X | X | |
| 3 | 3 | 0 AGCAACGCG | GTGAGG | GAGTGAGGA | | X | X | |
| 3 | 3 | 0 TGAAGTGTC | AGCTC | GAGTGAGGA | | X | X | |
| 3 | 3 | 0 AGCAACTCC | GTCTT | GAGTGAGGA | | X | X | |
| 3 | 3 | 0 AGAAATGTC | TTCCAG | GAGTGAGGA | | X | X | |
| 3 | 3 | 0 GGCAGGGTA | TCACAG | GAGTGAGGA | | X | X | |
| 3 | 3 | 0 AGCAACATG | GAGTT | GAGTGAGGA | | X | X | |
| 3 | 3 | 0 GACAGCGTG | GCCAGT | GAGTGAGGA | | X | X | |
| 3 | 3 | 0 GGCTGAGTC | ACTCT | GAGTGAGGA | | X | X | |
| 3 | 3 | 0 TGCAGAGTT | TTGTG | GAGTGAGGA | | X | X | |
| 3 | 3 | 0 AGCTGAGTG | CTGGAT | GAGTGAGGA | | X | X | |
| 3 | 3 | 0 AACTGAGTC | TCTGA | GAGTGAGGA | | X | X | |
| 3 | 3 | 0 AACATAGTC | TGTACA | GAGTGAGGA | | X | X | |
| 3 | 3 | 0 AGCTGGGTG | ACAGT | GAGTGAGGA | | X | X | |
| 3 | 3 | 0 AGCACCATA | TGGCT | GAGTGAGGA | | X | X | |
| 3 | 3 | 0 ATCAGGTTC | CTTCT | GAGTGAGGA | | X | X | |
| 3 | 3 | 0 ACCACGGTC | AGGTCT | GAGTGAGGA | | X | X | |
| 3 | 3 | 0 ACCACGGTC | AGGTCT | GAGTGAGGA | | X | X | |
| 3 | 3 | 0 ACCACGGTC | AGGTCT | GAGTGAGGA | | X | X | |
| 3 | 3 | 0 ACCACGGTC | AGGTCT | GAGTGAGGA | | X | X | |
| 3 | 3 | 0 ACCATGGTC | AAGTCT | GAGTGAGGA | | X | X | |
| 3 | 3 | 0 AGAAACTTC | CTCTC | GAGTGAGGA | | X | X | |
| 3 | 3 | 0 CACAGCTTC | TCACAG | GAGTGAGGA | | X | X | |
| 3 | 3 | 0 ATCATGGTC | TTAGA | GAGTGAGGA | | X | X | |
| 3 | 3 | 0 AGCAGTGAT | TGAGG | GAGTGAGGA | | X | X | |
| 3 | 3 | 0 ACCAAGGTC | ACACT | GAGTGAGGA | | X | X | |
| 3 | 3 | 0 AGCCCCTTC | CTAGAG | GAGTGAGGA | | X | X | |

| # of mutations | | | | | | VF2468 concentration | | |
|---|---|---|---|---|---|---|---|---|
| T (−) | (+) | (−) site | spacer | (+) site | | 4 nM | 2 nM | 10.5 nM |
| 3 | 3 | 0 | CTCAGTGTC | TAAGCA | GAGTGAGGA | X | X | |
| 3 | 3 | 0 | AGTTGCTTC | CTGAG | GAGTGAGGA | X | X | |
| 3 | 3 | 0 | AAGAGAGTC | TGAAA | GAGTGAGGA | X | X | |
| 3 | 3 | 0 | GGCAGTGTG | GTCACC | GAGTGAGGA | X | X | |
| 3 | 3 | 0 | TGCAGAGTT | GGGTCA | GAGTGAGGA | X | X | |
| 3 | 3 | 0 | AGCCTCGTT | GCCAGA | GAGTGAGGA | X | X | |
| 3 | 3 | 0 | ATCATCTTC | AAGTAA | GAGTGAGGA | X | X | |
| 3 | 3 | 0 | AGTAGTGTG | TGAAGG | GAGTGAGGA | X | X | |
| 3 | 3 | 0 | AGCCTCGTG | TCCTCA | GAGTGAGGA | X | X | |
| 3 | 3 | 0 | AAAAGCGTT | TGGGAA | GAGTGAGGA | X | X | |
| 3 | 3 | 0 | ACTAGAGTC | CCCCAA | GAGTGAGGA | X | X | |
| 3 | 3 | 0 | GGCGGCGGC | GAAGG | GAGTGAGGA | X | X | |
| 3 | 3 | 0 | ATGAGAGTC | CTGGG | GAGTGAGGA | X | X | |
| 3 | 3 | 0 | AGCACAGTG | GCCTGA | GAGTGAGGA | X | X | |
| 3 | 3 | 0 | TACAGGGTC | CTCGGT | GAGTGAGGA | X | X | |
| 3 | 3 | 0 | AGCAGAGGT | GCTGA | GAGTGAGGA | X | X | |
| 3 | 3 | 0 | GGAAGAGTC | CAGGG | GAGTGAGGA | X | X | |
| 3 | 3 | 0 | GGAAGAGTC | CAGGG | GAGTGAGGA | X | X | |
| 3 | 3 | 0 | AGTGGGGTC | TGTTGG | GAGTGAGGA | X | X | |
| 3 | 3 | 0 | ATGAGGGTC | ACTGAG | GAGTGAGGA | X | X | |
| 3 | 3 | 0 | GTCAGAGTC | CTAGG | GAGTGAGGA | X | X | |
| 3 | 3 | 0 | GCCAGGGTC | TGGGAG | GAGTGAGGA | X | X | |
| 3 | 3 | 0 | AGCAACTCC | ATCTT | GAGTGAGGA | X | X | |
| 3 | 3 | 0 | AGGGGAGTC | GACAG | GAGTGAGGA | X | X | |
| 3 | 3 | 0 | GTCAGGGTC | ATCAG | GAGTGAGGA | X | X | |
| 3 | 3 | 0 | GTCAGGGTC | ATCAG | GAGTGAGGA | X | X | |
| 3 | 3 | 0 | AGCATAGTA | GTTAA | GAGTGAGGA | X | X | |
| 3 | 3 | 0 | GTCAGAGTC | CAAAA | GAGTGAGGA | X | X | |
| 3 | 3 | 0 | GGCAGTGTT | ACAAA | GAGTGAGGA | X | X | |
| 3 | 3 | 0 | GCCATCGTC | ACCCA | GAGTGAGGA | X | X | |
| 3 | 3 | 0 | CTCAGTGTC | GAGAGA | GAGTGAGGA | X | X | |
| 3 | 3 | 0 | GGAAGAGTC | AAGGA | GAGTGAGGA | X | X | |
| 3 | 3 | 0 | AGCAACTCC | AGAAGA | GAGTGAGGA | X | X | |
| 3 | 3 | 0 | AGCCTCGGC | GGCCCT | GAGTGAGGA | X | X | |
| 3 | 3 | 0 | GACAGGGTC | ACTTTA | GAGTGAGGA | X | X | |
| 3 | 3 | 0 | AGAATAGTC | CTGGG | GAGTGAGGA | X | X | |
| 3 | 3 | 0 | AGTAGAGTA | GTAAAG | GAGTGAGGA | X | X | |
| 3 | 3 | 0 | GGGAGGGTC | GGTCAG | GAGTGAGGA | X | X | |
| 3 | 3 | 0 | AACAGGGTT | ATCCA | GAGTGAGGA | X | X | |
| 3 | 3 | 0 | GCCAGGGTC | ACCCA | GAGTGAGGA | X | X | |
| 3 | 3 | 0 | GGAAGAGTC | TTACCT | GAGTGAGGA | X | X | |
| 3 | 3 | 0 | AGTGGAGTC | ACCGTA | GAGTGAGGA | X | X | |
| 3 | 3 | 0 | GCCAGAGTC | ACCCTT | GAGTGAGGA | X | X | |
| 3 | 3 | 0 | GGCAGTGTA | ACTTAA | GAGTGAGGA | X | X | |
| 3 | 3 | 0 | CTCAGTGTC | GTTGT | GAGTGAGGA | X | X | |
| 3 | 3 | 0 | AGATGGGTC | TACAGA | GAGTGAGGA | X | X | |
| 3 | 3 | 0 | GCCAGAGTC | TGAGTG | GAGTGAGGA | X | X | |
| 3 | 3 | 0 | AGTAGGGTT | TGAAT | GAGTGAGGA | X | X | |
| 3 | 3 | 0 | CACTGCGTC | CTTGGT | GAGTGAGGA | X | X | |
| 3 | 3 | 0 | AACTGGGTC | CCTGAG | GAGTGAGGA | X | X | |
| 3 | 3 | 0 | AGTAACATC | AGTAGT | GAGTGAGGA | X | X | |
| 3 | 3 | 0 | GACAGAGTC | CACAGA | GAGTGAGGA | X | X | |
| 3 | 3 | 0 | ATCAGGTTC | CAATA | GAGTGAGGA | X | X | |
| 3 | 3 | 0 | AGCATGGTA | GTGGG | GAGTGAGGA | X | X | |
| 3 | 3 | 0 | AGCAACTGC | CCTTCT | GAGTGAGGA | X | X | |
| 3 | 3 | 0 | GGCTGAGTC | TTGCAG | GAGTGAGGA | X | X | |
| 3 | 3 | 0 | AGCAGCCCA | GGGGT | GAGTGAGGA | X | X | |
| 3 | 3 | 0 | AGCAAAGTG | TCAAT | GAGTGAGGA | X | X | |
| 3 | 3 | 0 | AGAAAAGTC | CACAGG | GAGTGAGGA | X | X | |
| 3 | 3 | 0 | AACAACTTC | TCCTG | GAGTGAGGA | X | X | |
| 3 | 3 | 0 | TGCGGAGTC | CCTGGG | GAGTGAGGA | X | X | |
| 3 | 3 | 0 | AGAATGGTC | TCTGAT | GAGTGAGGA | X | X | |
| 3 | 3 | 0 | AGCAGCAGA | ACAACT | GAGTGAGGA | X | X | |
| 3 | 3 | 0 | AGCAGCAGA | TATTG | GAGTGAGGA | X | X | |
| 3 | 3 | 0 | AGTTGCTTC | TTCTAA | GAGTGAGGA | X | X | |
| 3 | 3 | 0 | GACAGGGTC | CTGGA | GAGTGAGGA | X | X | |
| 3 | 3 | 0 | GGAAGAGTC | CGGGG | GAGTGAGGA | X | X | |
| 3 | 3 | 0 | GGAAGAGTC | CAAAG | GAGTGAGGA | X | X | |
| 3 | 3 | 0 | AGGGGGGTC | AAGAGT | GAGTGAGGA | X | X | |
| 3 | 3 | 0 | AACAACTTC | CATGT | GAGTGAGGA | X | X | |
| 3 | 3 | 0 | ACCAAGGTC | AGCAGG | GAGTGAGGA | X | X | |

| # of mutations T (−) (+) (−) | site | spacer | (+) site | VF2468 concentration 4 nM | 2 nM | 10.5 nM |
|---|---|---|---|---|---|---|
| 3 3 0 | GGCCACGTC | GCACAG | GAGTGAGGA | X | X | |
| 3 3 0 | AGCAAGGTT | AGGAAG | GAGTGAGGA | X | X | |
| 3 3 0 | AGTAGGGTT | GGAGGG | GAGTGAGGA | X | X | |
| 4 0 4 | AGCAGCGTC | ACAAAA | TAGCAAGGT | X | X | |
| 4 0 4 | AGCAGCGTC | AAGGG | GAGACAAGT | X | X | |
| 4 0 4 | AGCAGCGTC | CGTCCC | GAGAGGCGC | X | X | |
| 4 1 3 | AGCAGCGGC | CTAGC | GGGTGAGTC | X | X | |
| 4 1 3 | AGCAGCGTT | GCTAT | GAGAAAGGT | X | X | |
| 4 1 3 | AGCAACGTC | ATGTGC | TGGGGAGGA | X | X | |
| 4 1 3 | AGCAGCGGC | CGGAG | AAGTGTGGG | X | X | |
| 4 1 3 | AGCAACGTC | TGTTT | GTGTAAGGC | X | X | |
| 4 1 3 | AGCAACGTC | ACCTG | GAGTCACGC | X | X | |
| 4 1 3 | AGCAGTGTC | ATGATG | GTGTGTGAA | X | X | |
| 4 1 3 | AGCAGCGGC | CACATA | GTGTGTGAA | X | X | |
| 4 1 3 | AGCAACGTC | CAGTCC | AAGTGTGGC | X | X | |
| 4 1 3 | AGCAACGTC | GGATGC | AGGTGAGCA | X | X | |
| 4 1 3 | ATCAGCGTC | CAGATG | GTGTGAGTC | X | X | |
| 4 1 3 | AGCAACGTC | CTTAC | TAGTGAATA | X | X | |
| 4 1 3 | AGCAACGTC | GTGAC | GTGCGATGA | X | X | |
| 4 1 3 | AGCAGTGTC | TGTCTG | GAGTGTTGC | X | X | |
| 4 1 3 | AGCAGCGTT | GTTTTG | ATGTGAGGC | X | X | |
| 4 1 3 | AGCAACGTC | TGTGT | GAGTGACAG | X | X | |
| 4 1 3 | AGCACCGTC | TGCCG | GTGTGCGGT | X | X | |
| 4 1 3 | AGCAACGTC | CAGTCC | AAGTGTGGC | X | X | |
| 4 2 2 | AGCATTGTC | TTGTGG | GAGTAAGGC | X | X | |
| 4 2 2 | AGCAGCGAT | GGGGTT | GAGTGAGAC | X | X | |
| 4 2 2 | AGCTGTGTC | ATCCAT | GAGTGAGTC | X | X | |
| 4 2 2 | AGCATGGTC | AAGTTC | TAGTGAGGG | X | X | |
| 4 2 2 | AGCATGGTC | AAGTTC | TAGTGAGGG | X | X | |
| 4 2 2 | AGCATCTTC | ATATG | GAGTGAGAG | X | X | |
| 4 2 2 | AGCATGGTC | AGGTTC | TAGTGAGGG | X | X | |
| 4 2 2 | AGCATAGTC | AAGGG | GAGTGAGAG | X | X | |
| 4 2 2 | AGCATGGTC | TCTTTC | TAGTGAGGG | X | X | |
| 4 2 2 | AGCATGGTC | AGGTTC | TAGTGAGGG | X | X | |
| 4 2 2 | AGCATAGTC | TTTATT | GAGTGAGAG | X | X | |
| 4 2 2 | AGCAAAGTC | CTGAAG | GAGTGAGAG | X | X | |
| 4 2 2 | AGCAGCGCA | AAGCAC | GTGTGAGGC | X | X | |
| 4 2 2 | ATCAACGTC | TGGAC | TAGTGAGGG | X | X | |
| 4 2 2 | AGTAGTGTC | CACAG | AAGTGAGGG | X | X | |
| 4 2 2 | AGCAAAGTC | CCTTG | GAGTGAGTG | X | X | |
| 4 2 2 | AGCCACGTC | TATGCT | TTGTGAGGA | X | X | |
| 4 2 2 | AGCATGGTC | GGGTTC | TAGTGAGGG | X | X | |
| 4 2 2 | AGCAGAGTT | GGGAAA | AAGTGAGGG | X | X | |
| 4 2 2 | AGCATTGTC | ACTGT | GAGTGAGAG | X | X | |
| 4 2 2 | AGCATGGTC | AGGTTC | TAGTGAGGG | X | X | |
| 4 2 2 | AGCATGGTC | AGGTTC | TAGTGAGGG | X | X | |
| 4 2 2 | AGCATGGTC | TAGCA | GAGTGAGTC | X | X | |
| 4 2 2 | AGCTGTGTC | ATCCAT | GAGTGAGTC | X | X | |
| 4 2 2 | AGTAGAGTC | TGGGTG | GAGTGAGAC | X | X | |
| 4 2 2 | AGCATGGTC | AGGTTC | TAGTGAGGG | X | X | |
| 4 2 2 | AGCTGTGTC | CAGGAG | GAGTGAGTC | X | X | |
| 4 2 2 | AGCAACTTC | TGATC | TAGTGAGGT | X | X | |
| 4 2 2 | AGCTGAGTC | AACCT | GAGTAAGGG | X | X | |
| 4 2 2 | AGTAGGGTC | ATCAG | AAGTGAGGT | X | X | |
| 4 2 2 | AGCTGTGTC | ACCTT | GAGTGAGTC | X | X | |
| 4 2 2 | AGCAACATC | TGGAA | GAGTGAGAG | X | X | |
| 4 2 2 | AGCATCGTG | TTTGA | AAGTGAGGC | X | X | |
| 4 2 2 | AGCATGGTC | AGGTTC | TAGTGAGGG | X | X | |
| 4 2 2 | AGCAACTTC | AGGGG | AAGTGAGGG | X | X | |
| 4 2 2 | AGCATGGTC | AGATTA | TAGTGAGGG | X | X | |
| 4 2 2 | AGCATGGTC | CGTGTC | TAGTGAGGG | X | X | |
| 4 2 2 | AGCAAGGTC | ACCTGA | GAGTGAGAG | X | X | |
| 4 2 2 | AGCATGGTC | AAGTTC | TAGTGAGGG | X | X | |
| 4 2 2 | AGCAGGGTA | TAGGG | GAGTGAGAT | X | X | |
| 4 2 2 | GGCAGAGTC | CAAGCA | GAGTGAGAG | X | X | |
| 4 2 2 | AGTAACGTC | AAAGGT | GAGTGAAAA | X | X | |
| 4 2 2 | AGCATGGTC | AATTTC | TAGTGAGGG | X | X | |
| 4 2 2 | AGCAGTGTG | GAGTG | GAGTGAGAG | X | X | |
| 4 2 2 | AGCACCATC | CCCAT | GAGTGAGTC | X | X | |
| 4 2 2 | AGCAACGTG | AGACAG | TAGTGAGAA | X | X | |
| 4 2 2 | AGCAACGGC | CCTGGG | CAGTGAGGG | X | X | |

| # of mutations T | # of mutations (+) | # of mutations (−) | (−) site | spacer | (+) site | VF2468 concentration 4 nM | VF2468 concentration 2 nM | VF2468 concentration 10.5 nM |
|---|---|---|---|---|---|---|---|---|
| 4 | 2 | 2 | AGTAGAGTC | ATGGA | GAGTGAGAG | X | X | |
| 4 | 2 | 2 | GGCACCGTC | GCTGA | GAGTGAGTC | X | X | |
| 4 | 2 | 2 | AGCATGGTC | AGGTTC | TAGTGAGGG | X | X | |
| 4 | 2 | 2 | AGCATAGTC | AGGTTC | TAGTGAGGG | X | X | |
| 4 | 2 | 2 | AGTAACGTC | TCCCT | GAGTGTGGG | X | X | |
| 4 | 3 | 1 | AGCATAGTG | GTTAG | GAGTGAGGG | X | X | |
| 4 | 3 | 1 | ATCAGGGTG | GGTAG | GAGTGAGGC | X | X | |
| 4 | 3 | 1 | TACAGAGTC | TCCAG | GAGTGAGGG | X | X | |
| 4 | 3 | 1 | ATGAGGGTC | TCATA | GAGTGAGGT | X | X | |
| 4 | 3 | 1 | AGCAAATTC | TTCAG | GAGTGAGGT | X | X | |
| 4 | 3 | 1 | AGCAAAGTG | CTCAAA | GAGTGAGGC | X | X | |
| 4 | 3 | 1 | ATAAGTGTC | ATTGAA | GAGTGAGGC | X | X | |
| 4 | 3 | 1 | AGTAGTCTC | TTGAT | GAGTGAGGG | X | X | |
| 4 | 3 | 1 | CGCAGCAAC | AGCGGT | GAGTGAGGG | X | X | |
| 4 | 3 | 1 | AGCAATGTG | TGCTT | GAGTGAGGC | X | X | |
| 4 | 3 | 1 | ACCAAAGTC | TTTGAT | GAGTGAGGG | X | X | |
| 4 | 3 | 1 | AGTAGTGTT | TCAAGA | GAGTGAGGC | X | X | |
| 4 | 3 | 1 | AGCATAGTG | GGGTAG | GAGTGAGGG | X | X | |
| 4 | 3 | 1 | ATCACCATC | CTAAGT | GAGTGAGGG | X | X | |
| 4 | 3 | 1 | AGAATCGTT | TGAAA | GAGTGAGGG | X | X | |
| 4 | 3 | 1 | AGTAACATC | GGAAAA | GAGTGAGGT | X | X | |
| 4 | 3 | 1 | AGGACAGTC | AGTTG | GAGTGAGGT | X | X | |
| 4 | 3 | 1 | GGCAGTGTT | GACAG | GAGTGAGGC | X | X | |
| 4 | 3 | 1 | AGTTGTGTC | GTTTT | GAGTGAGGT | X | X | |
| 4 | 3 | 1 | CCCACCGTC | CCGCCC | GAGTGAGGG | X | X | |
| 4 | 3 | 1 | AGTACCGGC | TTCACA | GAGTGAGGT | X | X | |
| 4 | 3 | 1 | AGCAACTTT | GGAATG | GAGTGAGGG | X | X | |
| 4 | 3 | 1 | AGCAAGGGC | AGTGA | GAGTGAGGG | X | X | |
| 4 | 3 | 1 | GTCAGGGTC | ATAAGA | GAGTGAGGT | X | X | |
| 4 | 3 | 1 | AGGAAAGTC | TAACA | GAGTGAGGT | X | X | |
| 4 | 3 | 1 | CACAGTGTC | AGGCT | GAGTGAGGT | X | X | |
| 4 | 3 | 1 | GTCAGTGTC | CAAGAA | GAGTGAGGT | X | X | |
| 4 | 3 | 1 | ATCACCATC | CAGAGA | GAGTGAGGG | X | X | |
| 4 | 3 | 1 | ATCAACATC | TTTGG | GAGTGAGGC | X | X | |
| 4 | 3 | 1 | CCGAGCGTC | TGAAA | GAGTGAGGT | X | X | |
| 4 | 3 | 1 | AGCACAGTG | AGCACT | GAGTGAGGG | X | X | |
| 4 | 3 | 1 | AACATTGTC | TAAGG | GAGTGAGGT | X | X | |
| 4 | 3 | 1 | AACATTGTC | TAAGG | GAGTGAGGT | X | X | |
| 4 | 3 | 1 | AACATTGTC | TAAGG | GAGTGAGGT | X | X | |
| 4 | 3 | 1 | AGTACCGGC | ATCCAT | GAGTGAGGT | X | X | |
| 4 | 3 | 1 | AGTACAGTC | TCTGTT | GAGTGAGAA | X | X | |
| 4 | 3 | 1 | AACAACATC | ACGGG | GAGTGAGGT | X | X | |
| 4 | 3 | 1 | TCCCGCGTC | CGGGAA | GAGTGAGGT | X | X | |
| 4 | 3 | 1 | AGGGGAGTC | AGATGC | GAGTGAGGG | X | X | |
| 4 | 3 | 1 | AGTAGCTGC | GGCCA | GAGTGAGGC | X | X | |
| 4 | 3 | 1 | GGAAGGGTC | AGTGC | GAGTGAGGG | X | X | |
| 4 | 3 | 1 | GGAAGGGTC | AGTGC | GAGTGAGGG | X | X | |
| 4 | 3 | 1 | GGAAGGGTC | AGTGC | GAGTGAGGG | X | X | |
| 4 | 3 | 1 | GGAAGGGTC | AGTGC | GAGTGAGGG | X | X | |
| 4 | 3 | 1 | GGAAGGGTC | AGTGC | GAGTGAGGG | X | X | |
| 4 | 3 | 1 | CTCAGTGTC | TCCCA | GAGTGAGGC | X | X | |
| 4 | 3 | 1 | AGTAAAGTC | ACAAG | GAGTGAGGT | X | X | |
| 4 | 3 | 1 | AACGGGGTC | TGGGA | GAGTGAGGT | X | X | |
| 4 | 3 | 1 | GGGAGGGTC | CCCAT | GAGTGAGGG | X | X | |
| 4 | 3 | 1 | GGCAGGGTT | AAGATT | GAGTGAGGC | X | X | |
| 4 | 3 | 1 | AGGGGAGTC | TGAGGG | GAGTGAGGG | X | X | |
| 4 | 3 | 1 | AACAATGTC | ATGTT | GAGTGAGGG | X | X | |
| 4 | 3 | 1 | AGCTTGGTC | TGGCT | GAGTGAGGT | X | X | |
| 4 | 3 | 1 | ATGAGGGTC | TCATA | GAGTGAGGT | X | X | |
| 4 | 3 | 1 | GCCAGTGTC | TCTTAG | GAGTGAGGT | X | X | |
| 4 | 3 | 1 | ATCACAGTC | TCTGG | GAGTGAGGC | X | X | |
| 4 | 3 | 1 | GACAGGGTC | TTAAT | GAGTGAGGC | X | X | |
| 4 | 3 | 1 | AGCCTTGTC | GTAACT | GAGTGAGGT | X | X | |
| 4 | 3 | 1 | GGCAGCGGT | GTTCA | GAGTGAGGG | X | X | |
| 4 | 3 | 1 | TCCAGTGTC | TATGG | GAGTGAGGC | X | X | |
| 4 | 3 | 1 | AGCAGCTGT | GATGT | GAGTGAGGG | X | X | |
| 4 | 3 | 1 | AGCAGCTCA | CATGG | GAGTGAGGT | X | X | |
| 4 | 3 | 1 | GGCAACGGC | ACACA | GAGGGAGGA | X | X | |
| 4 | 3 | 1 | AGCTGAGTT | AAGCA | GAGTGAGGT | X | X | |
| 4 | 3 | 1 | AGCAGCACA | AAGCTG | GAGTGAGGG | X | X | |

| # of mutations | | | | | | VF2468 concentration | | |
|---|---|---|---|---|---|---|---|---|
| T (−) | (+) | (−) site | spacer | (+) site | | 4 nM | 2 nM | 10.5 nM |
| 4 | 3 | 1 | AGCAACCTT | GAGAT | GAGTGAGGC | X | X | |
| 4 | 3 | 1 | AGCAAATTC | GGGCCC | GAGTGAGGT | X | X | |
| 4 | 3 | 1 | AGACGGGTC | GGCCC | GAGTGAGGT | X | X | |
| 4 | 3 | 1 | GCCAGAGTC | TGCACA | GAGTGAGGG | X | X | |
| 4 | 3 | 1 | AGCAACAGC | ATTTGG | GAGTGAGGG | X | X | |
| 4 | 3 | 1 | AACCGAGTC | ACTCAA | GAGTGAGGG | X | X | |
| 4 | 3 | 1 | AGCAGCTCA | CCAGCA | GAGTGAGGT | X | X | |
| 4 | 3 | 1 | GGAAGGGTC | CTGTGT | GAGTGAGGG | X | X | |
| 4 | 3 | 1 | AGAACGGTC | CAGCA | GAGTGAGGC | X | X | |
| 4 | 3 | 1 | AGCAAGGTA | AGGAA | AAGTGAGGA | X | X | |
| 4 | 3 | 1 | AGAATGGTC | AGTGGG | GAGTGAGGG | X | X | |
| 4 | 3 | 1 | AGAATGGTC | CAAAT | GAGTGAGGG | X | X | |
| 4 | 3 | 1 | AGCAAGGGC | TCCGT | GAGTGAGGG | X | X | |
| 4 | 3 | 1 | TGCTGAGTC | TCCATG | GAGTGAGGG | X | X | |
| 4 | 3 | 1 | AGCATTGTT | TCTGGG | GAGTGAGGG | X | X | |
| 4 | 3 | 1 | AGCATTGTG | GTGAG | GAGTGAGGG | X | X | |
| 4 | 3 | 1 | GCTAGCGTC | CATGG | GAGTGAGGC | X | X | |
| 4 | 3 | 1 | AGCAACTTT | CCACTG | GAGTGAGGC | X | X | |
| 4 | 3 | 1 | AGTAGGGTT | GGTGG | GAGTGAGGG | X | X | |
| 4 | 3 | 1 | GGCAGTGTT | TCCCAG | GAGTGAGGC | X | X | |
| 4 | 3 | 1 | AACTGAGTC | TCTGG | GAGTGAGGT | X | X | |
| 4 | 3 | 1 | AGCATTGTG | ATGAG | GAGTGAGGG | X | X | |
| 4 | 3 | 1 | AGCAAGGTT | TATGT | GAGTGAGCA | X | X | |
| 4 | 3 | 1 | GGCAACGTT | TGTAT | GAGTGAGGT | X | X | |
| 4 | 3 | 1 | AACAACCTC | GCCTAT | GAGTGAGGG | X | X | |
| 4 | 3 | 1 | AGGGACGTC | CAAGG | GAGTGAGGG | X | X | |
| 4 | 3 | 1 | TCCAGTGTC | ACATCA | GAGTGAGGC | X | X | |
| 4 | 3 | 1 | AGCATGGTT | GGAGTA | GAGTGAGGG | X | X | |
| 4 | 3 | 1 | AATAGGGTC | AAAAT | GAGTGAGGT | X | X | |
| 4 | 3 | 1 | AGTATAGTC | TTTAGG | GAGTGAGGC | X | X | |
| 4 | 3 | 1 | TGCAATGTC | CTTGG | GAGTGAGGG | X | X | |
| 4 | 3 | 1 | AGCTACATC | TACAGG | GAGTGAGGG | X | X | |
| 4 | 3 | 1 | AGCAAAGTA | AAGAGA | GAGTGAGGG | X | X | |
| 4 | 4 | 0 | CACCCCGTC | TACCTG | GAGTGAGGA | X | X | |
| 4 | 4 | 0 | AGGCACGTT | AGGCA | GAGTGAGGA | X | X | |
| 4 | 4 | 0 | CACCCCGTC | GACGTC | GAGTGAGGA | X | X | |
| 4 | 4 | 0 | GCAAGAGTC | TGGCT | GAGTGAGGA | X | X | |
| 4 | 4 | 0 | AGTGCAGTC | CCTTA | GAGTGAGGA | X | X | |
| 4 | 4 | 0 | ATCCACGTT | ATGCTG | GAGTGAGGA | X | X | |
| 4 | 4 | 0 | ATCCACGTT | TTGGG | GAGTGAGGA | X | X | |
| 3 | 1 | 2 | AGCAGCTTC | TGCCAT | GAGTGAAGT | X | | X |
| 3 | 1 | 2 | AGCAGGGTC | TGCAGT | GAGAGAGGC | X | | X |
| 3 | 1 | 2 | AGCAGCTTC | CAGGA | GAGTGAAGT | X | | X |
| 3 | 1 | 2 | AGCAGGGTC | TGTTTT | GAGTGAGTT | X | | X |
| 4 | 3 | 1 | AGCAACTGC | ATTTT | GAGTGAGGG | X | | X |
| 4 | 3 | 1 | AGCAACTGC | ATCTT | GAGTGAGGG | X | | X |
| 3 | 1 | 2 | AGCAGCTTC | CCAAAA | ATGTGAGGA | X | | X |
| 3 | 3 | 0 | AGGTGCCTC | CCCATG | GAGTGAGGA | X | | X |
| 5 | 3 | 2 | AGCTCAGTC | CACAG | GAGTGAGTC | X | | X |
| 2 | 1 | 1 | AGCAGCGTG | CAGAA | GAGAGAGGA | X | | |
| 2 | 1 | 1 | AGCAGCGTG | GATGGA | GAGAGAGGA | X | | |
| 2 | 1 | 1 | AGCAGCGTG | GATGGA | GAGAGAGGA | X | | |
| 2 | 1 | 1 | AGCAGCGTG | GATGGA | GAGAGAGGA | X | | |
| 2 | 1 | 1 | AGCAGCCTC | TGCCAG | GGGTGAGGA | X | | |
| 2 | 1 | 1 | AGCAGCCTC | CCATA | GAGGGAGGA | X | | |
| 2 | 1 | 1 | AGGAGCGTC | CCTTGG | GAGTGATGA | X | | |
| 2 | 1 | 1 | AGCAGCGAC | AGCCA | GAGTGACGA | X | | |
| 2 | 1 | 1 | AGCTGCGTC | CTGTA | GCGTGAGGA | X | | |
| 2 | 1 | 1 | AGCAGGGTC | TGCCT | GAGTCAGGA | X | | |
| 2 | 1 | 1 | AGCAGCATC | TGGGA | GAATGAGGA | X | | |
| 2 | 1 | 1 | AGGAGCGTC | CAGTGC | GACTGAGGA | X | | |
| 2 | 1 | 1 | AGCAGCGTG | GATGGA | GAGAGAGGA | X | | |
| 2 | 1 | 1 | AGCAGCGTG | GATGGA | GAGAGAGGA | X | | |
| 2 | 1 | 1 | AGCAGCATC | ACAGAC | GCGTGAGGA | X | | |
| 2 | 1 | 1 | ACCAGCGTC | TGCTTT | GGGTGAGGA | X | | |
| 2 | 1 | 1 | AGCAGGGTC | ATTGA | GAATGAGGA | X | | |
| 2 | 2 | 0 | AGGAGCGAC | GGGGG | GAGTGAGGA | X | | |
| 2 | 2 | 0 | AGGAGCGAC | GGGGG | GAGTGAGGA | X | | |
| 2 | 2 | 0 | AGGAGCGAC | GGGGG | GAGTGAGGA | X | | |
| 2 | 2 | 0 | AGGAGCGAC | GGGGG | GAGTGAGGA | X | | |
| 2 | 2 | 0 | AGGAGCGAC | GGGGG | GAGTGAGGA | X | | |

| # of mutations T | (−) | (+) | (−) site | spacer | (+) site | 4 nM | 2 nM | 10.5 nM |
|---|---|---|---|---|---|---|---|---|
| 2 | 2 | 0 | AGGAGCGAC | GGGGG | GAGTGAGGA | X | | |
| 2 | 2 | 0 | AGGAGCGAC | GGGGG | GAGTGAGGA | X | | |
| 2 | 2 | 0 | AGGAGCGAC | GGGGG | GAGTGAGGA | X | | |
| 2 | 2 | 0 | AGGAGCGAC | GGGGG | GAGTGAGGA | X | | |
| 2 | 2 | 0 | AGGAGCGAC | GGGGG | GAGTGAGGA | X | | |
| 2 | 2 | 0 | AGGAGCGAC | GGGGG | GAGTGAGGA | X | | |
| 2 | 2 | 0 | AGGAGCGAC | GGGGG | GAGTGAGGA | X | | |
| 2 | 2 | 0 | AGGAGCGAC | GGGGG | GAGTGAGGA | X | | |
| 2 | 2 | 0 | AGGAGCGAC | GGGGG | GAGTGAGGA | X | | |
| 2 | 2 | 0 | AGGAGCGAC | GGGGG | GAGTGAGGA | X | | |
| 2 | 2 | 0 | AGGAGCGAC | GGGGG | GAGTGAGGA | X | | |
| 2 | 2 | 0 | AGGAGCGAC | GGGGG | GAGTGAGGA | X | | |
| 2 | 2 | 0 | AGGAGCGAC | GGGGG | GAGTGAGGA | X | | |
| 2 | 2 | 0 | AGGAGCGAC | GGGGG | GAGTGAGGA | X | | |
| 2 | 2 | 0 | AGGAGCGAC | GGGGG | GAGTGAGGA | X | | |
| 2 | 2 | 0 | AGGAGCGAC | GGGGG | GAGTGAGGA | X | | |
| 2 | 2 | 0 | AGGAGCGAC | GGGGG | GAGTGAGGA | X | | |
| 2 | 2 | 0 | AGGAGCGAC | GGGGG | GAGTGAGGA | X | | |
| 2 | 2 | 0 | AGGAGCGAC | GGGGG | GAGTGAGGA | X | | |
| 2 | 2 | 0 | AGGAGCGAC | GGGGG | GAGTGAGGA | X | | |
| 2 | 2 | 0 | AGGAGCGAC | GGGGG | GAGTGAGGA | X | | |
| 2 | 2 | 0 | AGGAGCGAC | GGGGG | GAGTGAGGA | X | | |
| 2 | 2 | 0 | AGGAGCGAC | GGGGG | GAGTGAGGA | X | | |
| 2 | 2 | 0 | AGGAGCGAC | GGGGG | GAGTGAGGA | X | | |
| 2 | 2 | 0 | AACAGCCTC | CTTCC | GAGTGAGGA | X | | |
| 2 | 2 | 0 | AGAAGCATC | CGAAGG | GAGTGAGGA | X | | |
| 2 | 2 | 0 | AGAAGCCTC | CATTCC | GAGTGAGGA | X | | |
| 3 | 0 | 3 | AGCAGCGTC | AGGGG | AAATTAGGA | X | | |
| 3 | 0 | 3 | AGCAGCGTC | TTGGAA | GACCGAGGT | X | | |
| 3 | 0 | 3 | AGCAGCGTC | CTGTG | GCGTGGCGA | X | | |
| 3 | 0 | 3 | AGCAGCGTC | TCAGCG | GGTGGAGGA | X | | |
| 3 | 0 | 3 | AGCAGCGTC | CGCCGA | GAGTCAGCC | X | | |
| 3 | 0 | 3 | AGCAGCGTC | AGGGAG | AAGTCAGGT | X | | |
| 3 | 0 | 3 | AGCAGCGTC | AACAGT | GCCTGATGA | X | | |
| 3 | 0 | 3 | AGCAGCGTC | AGTAGA | GACAGAGAA | X | | |
| 3 | 0 | 3 | AGCAGCGTC | GGGTGG | GTTTGGGA | X | | |
| 3 | 0 | 3 | AGCAGCGTC | TCCGAA | GAGACAGCA | X | | |
| 3 | 0 | 3 | AGCAGCGTC | CCGAG | GAGCTGGGA | X | | |
| 3 | 0 | 3 | AGCAGCGTC | CGGCC | GCGGCAGGA | X | | |
| 3 | 0 | 3 | AGCAGCGTC | CGGCC | GCGGCAGGA | X | | |
| 3 | 0 | 3 | AGCAGCGTC | ACTCCC | AAGCGAGTA | X | | |
| 3 | 0 | 3 | AGCAGCGTC | CCCTG | CAGAGAGCA | X | | |
| 3 | 0 | 3 | AGCAGCGTC | TCTCTG | GGCTGGGGA | X | | |
| 3 | 0 | 3 | AGCAGCGTC | CAGGAG | GGCTGGGGA | X | | |
| 3 | 0 | 3 | AGCAGCGTC | AGGGTG | GAGTCATGT | X | | |
| 3 | 0 | 3 | AGCAGCGTC | TGATTG | GCGGGGGA | X | | |
| 3 | 0 | 3 | AGCAGCGTC | TGGGG | AATTGGGA | X | | |
| 3 | 0 | 3 | AGCAGCGTC | CGCCGA | GAGTCAGCC | X | | |
| 3 | 1 | 2 | AGCAGTGTC | AGTTG | GCGGGAGGA | X | | |
| 3 | 1 | 2 | AGCAGAGTC | CAAAAG | GGGTGAGGC | X | | |
| 3 | 1 | 2 | ATCAGCGTC | CAGAG | GAGTGAACA | X | | |
| 3 | 1 | 2 | AGCAGAGTC | TCAGAG | GAGTGAAGC | X | | |
| 3 | 1 | 2 | AACAGCGTC | CTGGGA | GAGTGTGCA | X | | |
| 3 | 1 | 2 | TGCAGCGTC | TTCTT | TAGTGAGCA | X | | |
| 3 | 1 | 2 | AGCAGCTTC | CAACAA | TAGTAAGGA | X | | |
| 3 | 1 | 2 | AGCAGTGTC | CCCTAT | AAGTGAGAA | X | | |
| 3 | 1 | 2 | AGCAGCATC | AATCT | GAGTGTGGG | X | | |
| 3 | 1 | 2 | AGCAGTGTC | AACAT | CAGTGAGAA | X | | |
| 3 | 1 | 2 | AGCAGCTTC | TCCCA | GGGTGAGGC | X | | |
| 3 | 1 | 2 | AGCAGAGTC | AGGCA | GGGTGAGGC | X | | |
| 3 | 1 | 2 | AGCAGGGTC | TGCAGG | GAGTGTGGT | X | | |
| 3 | 1 | 2 | AGCTGCGTC | CTCTA | GAGGGAGGG | X | | |
| 3 | 1 | 2 | AGCAGCGTA | CCTGG | GTGTGAGAA | X | | |
| 3 | 1 | 2 | AGCAGCCTC | AGAAAT | AGGTGAGGA | X | | |
| 3 | 1 | 2 | AGCAGCGTT | CCTCT | CAGTGATGA | X | | |
| 3 | 1 | 2 | AGCAGCCTC | TGGAGG | GAGGGAGGG | X | | |

| # of mutations | | | (−) site | spacer | (+) site | VF2468 concentration | | |
|---|---|---|---|---|---|---|---|---|
| T | (+) | (−) | | | | 4 nM | 2 nM | 10.5 nM |
| 3 | 1 | 2 | AGCAGTGTC | AGATGG | TGGTGAGGA | X | | |
| 3 | 1 | 2 | AGCAGTGTC | TTGTTA | AAGTGAAGA | X | | |
| 3 | 1 | 2 | AGCAGCATC | TGGGTA | GAGTGAAGG | X | | |
| 3 | 1 | 2 | AGCAGCATC | CTCCT | GGGTAAGGA | X | | |
| 3 | 1 | 2 | AGCAGGGTC | CCTCT | GAGTGGGGC | X | | |
| 3 | 1 | 2 | ATCAGCGTC | TTTCTT | GAGTGATAA | X | | |
| 3 | 1 | 2 | AGCAGCATC | CTCCT | GGGTAAGGA | X | | |
| 3 | 1 | 2 | AGCAGCATC | CTCCT | GGGTAAGGA | X | | |
| 3 | 1 | 2 | AGCAGCATC | CTCCT | GGGTAAGGA | X | | |
| 3 | 1 | 2 | AGCAGCATC | CTCCT | GGGTAAGGA | X | | |
| 3 | 1 | 2 | AGCAGTGTC | TTAGGG | GAATGAGGC | X | | |
| 3 | 1 | 2 | AGCAGCTTC | CAGGCA | GAGGGAGAA | X | | |
| 3 | 1 | 2 | AGCAGCGTG | CTGCGA | GAGTGTGAA | X | | |
| 3 | 1 | 2 | AGTAGCGTC | CTTGG | GATTGAAGA | X | | |
| 3 | 1 | 2 | AGCAGCTTC | CAGACT | GAGGGAGAA | X | | |
| 3 | 1 | 2 | AGCAGCGTG | GAGGA | GAGAGAGGC | X | | |
| 3 | 1 | 2 | ATCAGCGTC | ATCCA | GAAGGAGGA | X | | |
| 3 | 1 | 2 | AGCAGCATC | AAAGAG | GAGAGAGGG | X | | |
| 3 | 1 | 2 | AGCAGTGTC | TTCCAT | GAGTGGGTA | X | | |
| 3 | 1 | 2 | AGCAGCGAC | TGTAG | AAATGAGGA | X | | |
| 3 | 1 | 2 | AGCAGTGTC | GATACA | TGGTGAGGA | X | | |
| 3 | 1 | 2 | AGCAGCGTG | GAGAG | GAGGAAGGA | X | | |
| 3 | 1 | 2 | AGCAGCTTC | ACTGT | GACTGAAGA | X | | |
| 3 | 1 | 2 | AGCAGAGTC | CTCTT | TTGTGAGGA | X | | |
| 3 | 1 | 2 | AGCAGCTTC | TCCAG | CAGTGATGA | X | | |
| 3 | 1 | 2 | AGCAGTGTC | ATACT | AAGGGAGGA | X | | |
| 3 | 1 | 2 | AGCCGCGTC | TCCAA | GAGTCAGTA | X | | |
| 3 | 1 | 2 | TGCAGCGTC | AAATTG | GAGTAAGGG | X | | |
| 3 | 1 | 2 | AGCAGCATC | AGAGGT | GTGTGAGAA | X | | |
| 3 | 1 | 2 | AGCAGCGTG | TTCATG | GAGTGCGGC | X | | |
| 3 | 1 | 2 | AGCAGTGTC | CTTTG | CAGTGAGAA | X | | |
| 3 | 1 | 2 | AGCAGCGCC | TCTCA | GAGTGAACA | X | | |
| 3 | 1 | 2 | AGCAGCATC | TTGGG | AACTGAGGA | X | | |
| 3 | 1 | 2 | AGCAGCCTC | TTTTTG | GAGGGAGGG | X | | |
| 3 | 1 | 2 | GGCAGCGTC | GCAGG | GAGTGGGAA | X | | |
| 3 | 1 | 2 | AGCAGCCTC | GGAAAC | AAGTGAGGG | X | | |
| 3 | 1 | 2 | AGCAGAGTC | TGATAT | GAGTGAGCT | X | | |
| 3 | 1 | 2 | TGCAGCGTC | AGCAT | GAGTGGGGC | X | | |
| 3 | 1 | 2 | AGCAGGGTC | TGGAGG | GAGACAGGA | X | | |
| 3 | 1 | 2 | AGCAGAGTC | ACGAGA | GAATGGGGA | X | | |
| 3 | 1 | 2 | AGCAGGGTC | CTGCA | GGGTGAGGC | X | | |
| 3 | 1 | 2 | AGCAGCCTC | AGGGAT | GAGGGAGGT | X | | |
| 3 | 1 | 2 | AGCAGCGGC | ATCGG | GGGCGAGGA | X | | |
| 3 | 1 | 2 | AGCAGGGTC | ATCACA | GAGGGAAGA | X | | |
| 3 | 1 | 2 | AGCAGTGTC | TGGTGT | GAGGGAGCA | X | | |
| 3 | 1 | 2 | AGCAGCGGC | TGGGGG | GAGGCAGGA | X | | |
| 3 | 1 | 2 | AGCAGCATC | CCTGGA | GAGGGAGAA | X | | |
| 3 | 1 | 2 | AGCAGGGTC | GGTGTC | TGGTGAGGA | X | | |
| 3 | 1 | 2 | AGCAGGGTC | CAGGT | AAGAGAGGA | X | | |
| 3 | 1 | 2 | AGCAGTGTC | ATCTCT | GAGTGGAGA | X | | |
| 3 | 1 | 2 | AGCAGCCTC | CGTCTA | GAGGGAGGT | X | | |
| 3 | 1 | 2 | AGCAGCGCC | AGCCTC | AAGTGAGGG | X | | |
| 3 | 1 | 2 | AGCAGCGAC | ATTGT | GAGTAAGCA | X | | |
| 3 | 1 | 2 | AGCAGCTTC | CGGTG | TAGTGATGA | X | | |
| 3 | 1 | 2 | AGCAGGGTC | CCAGCA | GAGAAAGGA | X | | |
| 3 | 1 | 2 | AGCAGCGAC | TCCGG | GAGTGCAGA | X | | |
| 3 | 1 | 2 | AGCAGCGTG | GGAAA | GAGGAAGGA | X | | |
| 3 | 1 | 2 | GGCAGCGTC | TATGGA | GAATGAGAA | X | | |
| 3 | 1 | 2 | AGCAGCCTC | CACACT | GAGGGAGGT | X | | |
| 3 | 1 | 2 | AGCAGCCTC | CCTCTT | GTGTGAGGG | X | | |
| 3 | 1 | 2 | TGCAGCGTC | GCTGA | AAGTGAGAA | X | | |
| 3 | 1 | 2 | AGCAGTGTC | TTGTAT | GACTGAGGT | X | | |
| 3 | 1 | 2 | AGCAACGTC | AGCAAA | GTGTCAGGA | X | | |
| 3 | 1 | 2 | AGCAGCATC | AGCAG | GAGTGTGAA | X | | |
| 3 | 1 | 2 | AGCAGCCTC | ATTGG | GAGTGAGTG | X | | |
| 3 | 1 | 2 | AGCAGGGTC | TTGGAT | GAGTTAAGA | X | | |
| 3 | 1 | 2 | AGCAGCGGC | AGACT | GAGCGAGCA | X | | |
| 3 | 1 | 2 | AGCAGGGTC | CTGTTG | GAGACAGGA | X | | |
| 3 | 1 | 2 | AGCAGCATC | AGCAT | CAGTTAGGA | X | | |
| 3 | 1 | 2 | AGCAGAGTC | AGAAAT | GAGTGAAGC | X | | |
| 3 | 1 | 2 | AGCAGCGCC | CACCCT | TGGTGAGGA | X | | |

| # of mutations | | | (-) site | spacer | (+) site | VF2468 concentration | | |
|---|---|---|---|---|---|---|---|---|
| T (-) | (+) | (-) | | | | 4 nM | 2 nM | 10.5 nM |
| 3 | 1 | 2 | AGCAGCGGC | TGATG | GAGGCAGGA | X | | |
| 3 | 1 | 2 | AGCAGCCTC | GCTTTG | AGGTGAGGA | X | | |
| 3 | 1 | 2 | AGCATCGTC | ATCCTA | GAGTCAGCA | X | | |
| 3 | 1 | 2 | GGCAGCGTC | GGGCA | GAGGGAGAA | X | | |
| 3 | 1 | 2 | AGCAGCCTC | ATCCT | GTGAGAGGA | X | | |
| 3 | 1 | 2 | AGCAGTGTC | TTCCAT | GAGTGGGTA | X | | |
| 3 | 1 | 2 | GGCAGCGTC | CAATCT | CAGTGAGAA | X | | |
| 3 | 1 | 2 | AGCAGTGTC | ACCTCT | GAGTGGGTA | X | | |
| 3 | 1 | 2 | AGCAGCATC | TATAGC | GACTGAGGT | X | | |
| 3 | 1 | 2 | AGCAGTGTC | TGGTTT | GGGGGAGGA | X | | |
| 3 | 1 | 2 | AGCAGAGTC | GGAGT | GAGAGAGGG | X | | |
| 3 | 1 | 2 | AGTAGCGTC | TAGGC | AAGTGAGCA | X | | |
| 3 | 1 | 2 | AGCAGCCTC | TACAT | GAGTGAGAC | X | | |
| 3 | 1 | 2 | AGCAGTGTC | AATAA | GAGAGTGGA | X | | |
| 3 | 1 | 2 | AGCAGCGTT | TCTCA | AAGTGCGGA | X | | |
| 3 | 1 | 2 | AGCAGCGAC | TGTGA | AAGTGAGAA | X | | |
| 3 | 1 | 2 | AGCAGAGTC | CCTGT | GAGTGAAGG | X | | |
| 3 | 1 | 2 | GGCAGCGTC | CTTTC | CAGCGAGGA | X | | |
| 3 | 1 | 2 | AGCAGGGTC | AATGTC | TGGTGAGGA | X | | |
| 3 | 1 | 2 | AGCAGCATC | AGGCT | GAGTGTGGT | X | | |
| 3 | 1 | 2 | AGCAGTGTC | TCGTT | AGGTGAGGA | X | | |
| 3 | 1 | 2 | AGCAGGGTC | AGCAAA | GAATGAGGC | X | | |
| 3 | 1 | 2 | AGCAGAGTC | ACAAA | GAATGAGTA | X | | |
| 3 | 1 | 2 | AGCAGCGTG | GGGCTG | GAGGGAGAA | X | | |
| 3 | 1 | 2 | AGCAGCGTG | TTCATG | GAGTGCGGC | X | | |
| 3 | 1 | 2 | AGCAGCATC | TAACAG | GAGGGAGGG | X | | |
| 3 | 1 | 2 | AGCAGCCTC | CTAGG | GAGGGAGGG | X | | |
| 3 | 1 | 2 | AGCAGCTTC | TGAGC | TAGTGAAGA | X | | |
| 3 | 1 | 2 | ATCAGCGTC | TACTAA | GAGAGTGGA | X | | |
| 3 | 1 | 2 | AGCAGCATC | ACCTGC | GAGGGAGGG | X | | |
| 3 | 1 | 2 | AGCAGCATC | GAGTT | GGGTGAGGT | X | | |
| 3 | 1 | 2 | TGCAGCGTC | CAAGCT | CAGTGAGGC | X | | |
| 3 | 1 | 2 | AGCAGCTTC | ATTTT | GAATGAGGG | X | | |
| 3 | 1 | 2 | AGCAGCCTC | TTTTGG | GAGTGGGGG | X | | |
| 3 | 1 | 2 | AGCAGCGCC | TCCCA | GAGTGGGGC | X | | |
| 3 | 1 | 2 | AGCAGGGTC | CCCCA | GAGAAGGA | X | | |
| 3 | 1 | 2 | AGCAGCCTC | CCGGA | GAGGGAGGG | X | | |
| 3 | 1 | 2 | GGCAGCGTC | GGGTGG | GAGAGAGAA | X | | |
| 3 | 1 | 2 | AGCAGAGTC | TACCTT | GAGTGAAAA | X | | |
| 3 | 1 | 2 | AGCAGCGAC | CCAAG | GAGTAAGAA | X | | |
| 3 | 1 | 2 | AGCAGTGTC | TTTAGA | AAGTGAGCA | X | | |
| 3 | 1 | 2 | AGCAGGGTC | GGGCC | TGGTGAGGA | X | | |
| 3 | 1 | 2 | AGCAGCGGC | TGAATC | CTGTGAGGA | X | | |
| 3 | 1 | 2 | TGCAGCGTC | TGGCAT | GAGTGGGGC | X | | |
| 3 | 1 | 2 | AGAAGCGTC | ATGCT | GAGTGAAAA | X | | |
| 3 | 1 | 2 | AGCAGGGTC | CAGGGA | GAGGGAAGA | X | | |
| 3 | 1 | 2 | AGCAGCATC | CCTGT | GAGTGAGTG | X | | |
| 3 | 1 | 2 | AGTAGCGTC | AATGAT | AAGTGTGGA | X | | |
| 3 | 1 | 2 | AGCAGGGTC | CAGGT | AAGAGAGGA | X | | |
| 3 | 1 | 2 | AGCAGGGTC | CAGGT | AAGAGAGGA | X | | |
| 3 | 1 | 2 | AGCAGGGTC | CAGGT | AAGAGAGGA | X | | |
| 3 | 2 | 1 | AGCAACCTC | ACCCCA | GAGAGAGGA | X | | |
| 3 | 2 | 1 | AGCAACGTG | TGTTGG | GAGAGAGGA | X | | |
| 3 | 2 | 1 | ATCAGGGTC | AGGTTT | TAGTGAGGA | X | | |
| 3 | 2 | 1 | AGCAAAGTC | TGTAT | GAGTGAGCA | X | | |
| 3 | 2 | 1 | AGCAGTGTA | AAGGAG | TAGTGAGGA | X | | |
| 3 | 2 | 1 | AGCAGAGTA | AAGCAG | GTGTGAGGA | X | | |
| 3 | 2 | 1 | AGCAGCCTG | GGAGA | GAGTGAGGG | X | | |
| 3 | 2 | 1 | AGCAACCTC | CTGGGT | GAGAGAGGA | X | | |
| 3 | 2 | 1 | AACAGCTTC | AGTACA | CAGTGAGGA | X | | |
| 3 | 2 | 1 | AGTAGTGTC | AATGAA | GAGTGAAGA | X | | |
| 3 | 2 | 1 | ATCAGGGTC | TAGGGA | GAGTGTGGA | X | | |
| 3 | 2 | 1 | GGCAGGGTC | CCCGG | GAGGGAGGA | X | | |
| 3 | 2 | 1 | AGCTGGGTC | TGAAGG | GTGTGAGGA | X | | |
| 3 | 2 | 1 | AGCTGGGTC | CTCAG | GAGAGAGGA | X | | |
| 3 | 2 | 1 | AGCAGCTCC | AGGGCC | GAGTGAGAA | X | | |
| 3 | 2 | 1 | AGCAACATC | CGCTCT | GAGTGGGGA | X | | |
| 3 | 2 | 1 | AACAGCTTC | ACAGG | CAGTGAGGA | X | | |
| 3 | 2 | 1 | ATCAGCGCC | CAACAC | CAGTGAGGA | X | | |
| 3 | 2 | 1 | AGCAGGGGC | AGTGG | GAGTGAGTA | X | | |
| 3 | 2 | 1 | AGCATGGTC | TGGTT | GGGTGAGGA | X | | |

| # of mutations | | | | | | VF2468 concentration | | |
|---|---|---|---|---|---|---|---|---|
| T (−) | (+) | (−) site | spacer | (+) site | 4 nM | 2 nM | 10.5 nM |
| 3 | 2 | 1 | GGCAGCGTG | CTCTGA | GAGAGAGGA | X | | |
| 3 | 2 | 1 | AGCAGAGCC | CCCTG | GAGTGAGGG | X | | |
| 3 | 2 | 1 | AGCACCGTG | CTTCAA | AAGTGAGGA | X | | |
| 3 | 2 | 1 | CCCAGCGTC | AGCAG | GAGTCAGGA | X | | |
| 3 | 2 | 1 | AGGAGCGTG | GACACA | GAGTGAGGT | X | | |
| 3 | 2 | 1 | AGCCGAGTC | TGTCCC | GAGTGTGGA | X | | |
| 3 | 2 | 1 | AGTAGAGTC | TCTGTT | GAGTGAGTA | X | | |
| 3 | 2 | 1 | ACCAGGGTC | ATGGC | AAGTGAGGA | X | | |
| 3 | 2 | 1 | TGCAGGGTC | AGATTG | AAGTGAGGA | X | | |
| 3 | 2 | 1 | AGCAGCGGG | GAGAGA | GAGCGAGGA | X | | |
| 3 | 2 | 1 | TGCAGCGCC | GAGGT | GAGTGAGGG | X | | |
| 3 | 2 | 1 | AGTAGAGTC | TGGCT | GAGGGAGGA | X | | |
| 3 | 2 | 1 | TGCAGCGCC | GAGGT | GAGTGAGGG | X | | |
| 3 | 2 | 1 | AGTAGGGTC | ACACTA | GAGTGAAGA | X | | |
| 3 | 2 | 1 | TGCAGCGCC | GAGGT | GAGTGAGGG | X | | |
| 3 | 2 | 1 | TGCAGCGCC | GAGGT | GAGTGAGGG | X | | |
| 3 | 2 | 1 | TGCAGCGCC | GAGGT | GAGTGAGGG | X | | |
| 3 | 2 | 1 | TGCAGCGCC | GAGGT | GAGTGAGGG | X | | |
| 3 | 2 | 1 | TGCAGCGCC | GAGGT | GAGTGAGGG | X | | |
| 3 | 2 | 1 | AGCAGGGTA | AAGCAA | GAGTGAGAA | X | | |
| 3 | 2 | 1 | AGCAGCGGG | GACCGG | GAGCGAGGA | X | | |
| 3 | 2 | 1 | AGCAGGTTC | AGTGTC | TAGTGAGGA | X | | |
| 3 | 2 | 1 | GGCATCGTC | TGCAGT | AAGTGAGGA | X | | |
| 3 | 2 | 1 | AATAGCGTC | AGCCCC | AAGTGAGGA | X | | |
| 3 | 2 | 1 | AGCAGCATG | GTATG | GAGGGAGGA | X | | |
| 3 | 2 | 1 | AGCAGCCTG | CTGCA | GAGTGAGGG | X | | |
| 3 | 2 | 1 | GGCAGCGTG | GTGGT | GAGAGAGGA | X | | |
| 3 | 2 | 1 | AGCAGAGTT | GGTGTC | TAGTGAGGA | X | | |
| 3 | 2 | 1 | AACAGAGTC | GGGAA | GAGTAAGGA | X | | |
| 3 | 2 | 1 | AACAGCGGC | GTCCT | GAGTGTGGA | X | | |
| 3 | 2 | 1 | AGCAGGGTG | TGAGA | GAGGGAGGA | X | | |
| 3 | 2 | 1 | AGCTGCATC | AAACT | TAGTGAGGA | X | | |
| 3 | 2 | 1 | GGCAGGGTC | TCCCG | GAGGGAGGA | X | | |
| 3 | 2 | 1 | AGCAGCTTT | TCAGA | GAGTGAAGA | X | | |
| 3 | 2 | 1 | AGCAGGGCC | CTGCT | GAGTGAGGG | X | | |
| 3 | 2 | 1 | AGCAGGGCC | CTGCT | GAGTGAGGG | X | | |
| 3 | 2 | 1 | GGCAGCGTT | GGGAT | GTGTGAGGA | X | | |
| 3 | 2 | 1 | AACAGAGTC | ACAGT | GAGTAAGGA | X | | |
| 3 | 2 | 1 | AGCAGGGCC | GGGCA | GAGTGAGGG | X | | |
| 3 | 2 | 1 | GGGAGCGTC | TGCCC | CAGTGAGGA | X | | |
| 3 | 2 | 1 | ATCAGTGTC | TAAAAT | GGGTGAGGA | X | | |
| 3 | 2 | 1 | AGCGGCTTC | TGCCT | GAGTGAGGG | X | | |
| 3 | 2 | 1 | AGCAATGTC | TGCCTT | GGGTGAGGA | X | | |
| 3 | 2 | 1 | AGCAAAGTC | ACCAG | GAGTGAGCA | X | | |
| 3 | 2 | 1 | AGCAATGTC | AATCAG | GAGAGAGGA | X | | |
| 3 | 2 | 1 | AGCAGGGTG | GAAAG | GAATGAGGA | X | | |
| 3 | 2 | 1 | ACCAGCCTC | CTGAGG | GAGTGAGGG | X | | |
| 3 | 2 | 1 | AGAAGCGGC | GTTGT | AAGTGAGGA | X | | |
| 3 | 2 | 1 | AGCAGTGTG | GTAGA | CAGTGAGGA | X | | |
| 3 | 2 | 1 | AGCAATGTC | AGTCT | GAGTTAGGA | X | | |
| 3 | 2 | 1 | AGCAGGGTG | TTGGAG | GAATGAGGA | X | | |
| 3 | 2 | 1 | AGCAGCATG | GAAAA | GAGGGAGGA | X | | |
| 3 | 2 | 1 | AGCAGCTTT | GTAGA | GAGTGAAGA | X | | |
| 3 | 2 | 1 | AGCAAGGTC | TGGGA | GAGTCAGGA | X | | |
| 3 | 2 | 1 | AGCAGCCTG | CCAAG | GAGTGAGGG | X | | |
| 3 | 2 | 1 | AGCAGTGGC | TAAGA | GAGTGAGCA | X | | |
| 3 | 2 | 1 | AACAGCGTG | TGTGA | AAGTGAGGA | X | | |
| 3 | 2 | 1 | AGCATCCTC | TATGCT | GTGTGAGGA | X | | |
| 3 | 2 | 1 | AGCAGAGCC | ATGAAG | GAGTGAGGC | X | | |
| 3 | 2 | 1 | AGCAGCCGC | CTGAG | CAGTGAGGA | X | | |
| 3 | 2 | 1 | AGCAGCGAG | GGAGG | AAGTGAGGA | X | | |
| 3 | 2 | 1 | AGCCGGGTC | TTCCG | AAGTGAGGA | X | | |
| 3 | 2 | 1 | AGCCTCGTC | CCCAGA | GAGGGAGGA | X | | |
| 3 | 2 | 1 | AGGAGAGTC | CCATGA | GAGTGAGAA | X | | |
| 3 | 2 | 1 | AGCAATGTC | AGATAG | GGGTGAGGA | X | | |
| 3 | 2 | 1 | AGCATCGGC | CTCTCT | GAGTGACGA | X | | |
| 3 | 2 | 1 | AGCATCTTC | AGTTG | AAGTGAGGA | X | | |
| 3 | 2 | 1 | GGCAGCGTG | TATGAT | GAGAGAGGA | X | | |
| 3 | 2 | 1 | AGCAGGGTA | AAGAGT | GAGTGAGAA | X | | |
| 3 | 2 | 1 | AACAGAGTC | AGCCCT | TAGTGAGGA | X | | |

-continued

| # of mutations | | | | | | VF2468 concentration | | |
|---|---|---|---|---|---|---|---|---|
| T (−) | (+) | (−) site | spacer | (+) site | 4 nM | 2 nM | 10.5 nM | |
| 3 2 | 1 | AGCACAGTC | CGGAT | GAGTGAGCA | X | | | |
| 3 2 | 1 | ATTAGCGTC | ACTTAG | AAGTGAGGA | X | | | |
| 3 2 | 1 | AACAGAGTC | AGAGA | TAGTGAGGA | X | | | |
| 3 2 | 1 | AGCAGCCTG | GCATG | GAGTGAGGG | X | | | |
| 3 2 | 1 | AACACCGTC | ACCTGT | GGGTGAGGA | X | | | |
| 3 2 | 1 | AGCAGCGGA | AATAA | GGGTGAGGA | X | | | |
| 3 2 | 1 | GGCAGCGTG | AACCCA | GAGTGAGTA | X | | | |
| 3 2 | 1 | AACACCGTC | CTGCCA | GTGTGAGGA | X | | | |
| 3 2 | 1 | AGCAGCGAT | GTTGT | AAGTGAGGA | X | | | |
| 3 2 | 1 | AGCAGGGTG | GGAAAG | GAGGGAGGA | X | | | |
| 3 2 | 1 | AGCTGGGTC | AGAGGT | GAGAGAGGA | X | | | |
| 3 2 | 1 | AGCAGCTCC | AGGGA | GAGTGAGAA | X | | | |
| 3 2 | 1 | AGCAATGTC | TTCCTT | GGGTGAGGA | X | | | |
| 3 2 | 1 | AGCACAGTC | TGAACA | GAGTGAGCA | X | | | |
| 3 2 | 1 | AGCAGCGGA | GGATCT | GGGTGAGGA | X | | | |
| 3 2 | 1 | AGCAGCTTT | TGGGA | GAGTGAGCA | X | | | |
| 3 2 | 1 | AGCAGCGAT | TTGAAG | AAGTGAGGA | X | | | |
| 3 2 | 1 | AGCAGCAGC | ACAAA | GAGTGAGTA | X | | | |
| 3 2 | 1 | AGGAGCGGC | AGGTGA | TAGTGAGGA | X | | | |
| 3 2 | 1 | AGCACGGTC | CAAAG | GAGAGAGGA | X | | | |
| 3 2 | 1 | AGCTGGGTC | ATTCCC | CAGTGAGGA | X | | | |
| 3 2 | 1 | AGCTGAGTC | AGCCAA | GTGTGAGGA | X | | | |
| 3 2 | 1 | AGTAGGGTC | AACGTT | GAGTGAAGA | X | | | |
| 3 2 | 1 | AGTAGAGTC | AACAGT | GAGTGATGA | X | | | |
| 3 2 | 1 | AGGAGAGTC | GCTCT | GAGTGAGAA | X | | | |
| 3 2 | 1 | AGCGCCGTC | TCTGG | AAGTGAGGA | X | | | |
| 3 2 | 1 | AGCTGTGTC | CCTCCT | GAGGGAGGA | X | | | |
| 3 2 | 1 | AGCTGCCTC | CGTGGG | GAGTGAGGC | X | | | |
| 3 2 | 1 | AGCAGCCTG | CTGCA | GAGTGAGGG | X | | | |
| 3 2 | 1 | AGCAGCCTG | CTGCA | GAGTGAGGG | X | | | |
| 3 2 | 1 | GGCAGAGTC | GTGCA | TAGTGAGGA | X | | | |
| 3 2 | 1 | AGCATTGTC | AATATT | GACTGAGGA | X | | | |
| 3 2 | 1 | AGCAGGGTG | GGTAA | GAGTGAGAA | X | | | |
| 3 2 | 1 | GGCAGGGTC | TCTGG | GAGGGAGGA | X | | | |
| 3 2 | 1 | AGTAGAGTC | CAGTA | GAGTGATGA | X | | | |
| 3 2 | 1 | AGCAGGGCC | CTGCT | GAGTGAGGG | X | | | |
| 3 2 | 1 | AGCAAAGTC | TTTAG | GAGAGAGGA | X | | | |
| 3 2 | 1 | AGCAGTGCC | CTGAA | GAGTGAGAA | X | | | |
| 3 2 | 1 | GGCAGGGTC | CGAGCC | CAGTGAGGA | X | | | |
| 3 2 | 1 | AGCTGGGTC | TGGCT | GAGTGTGGA | X | | | |
| 3 2 | 1 | AGCAGCTTT | CATGG | AAGTGAGGA | X | | | |
| 3 2 | 1 | ATCATCGTC | ATCGT | GAGAGAGGA | X | | | |
| 3 2 | 1 | AGCCGCGTG | AGGGC | AAGTGAGGA | X | | | |
| 3 2 | 1 | AGCAGGGTG | GGCAAG | GAGGGAGGA | X | | | |
| 3 2 | 1 | AGCATGGTC | AAGTTT | GGGTGAGGA | X | | | |
| 3 2 | 1 | ATCAGAGTC | AGAGA | AAGTGAGGA | X | | | |
| 3 2 | 1 | AGCAGTGGC | AGAAT | AAGTGAGGA | X | | | |
| 3 2 | 1 | AGGAGTGTC | TGCAA | AAGTGAGGA | X | | | |
| 3 2 | 1 | TGCAGGGTC | AAGCC | AAGTGAGGA | X | | | |
| 3 2 | 1 | AGCAGGTTC | AGTGTC | TAGTGAGGA | X | | | |
| 3 2 | 1 | AGCAGCGGA | AATAA | GGGTGAGGA | X | | | |
| 3 2 | 1 | AGCAGGGTG | CTCGG | GAGGGAGGA | X | | | |
| 3 2 | 1 | AGCAACCTC | CCCACA | GAGGGAGGA | X | | | |
| 3 2 | 1 | AGCAGGGTG | GGGGA | GAGGGAGGA | X | | | |
| 3 2 | 1 | AGCAACCTC | TGCTCA | GAGAGAGGA | X | | | |
| 3 2 | 1 | TGCAGGGTC | TGCGG | AAGTGAGGA | X | | | |
| 3 2 | 1 | AGCAGGTTC | AGACTG | AAGTGAGGA | X | | | |
| 3 2 | 1 | AGCAATGTC | ACCAT | GAGTGTGGA | X | | | |
| 3 2 | 1 | AGCACGGTC | CCCAAG | GAGGGAGGA | X | | | |
| 3 2 | 1 | AGCAGCGCT | CGGGC | GAGCGAGGA | X | | | |
| 3 2 | 1 | AGCAGGGAC | TGGTCA | GAGTGAGGT | X | | | |
| 3 2 | 1 | AGCAGCCAC | ACAATC | CAGTGAGGA | X | | | |
| 3 2 | 1 | AGTAGAGTC | AAGAGG | GAGTGAGTA | X | | | |
| 3 2 | 1 | AGCCTCGTC | TTGGT | GAGGGAGGA | X | | | |
| 3 2 | 1 | GGCAGCGGC | CTGGAG | GGGTGAGGA | X | | | |
| 3 2 | 1 | AGCAGAGTT | GGTTTC | TAGTGAGGA | X | | | |
| 3 2 | 1 | AGCATCTTC | ACCTG | AAGTGAGGA | X | | | |
| 3 2 | 1 | AGCAACATC | ATAAT | GAGTGGGGA | X | | | |
| 3 2 | 1 | AGCACAGTC | CCTAA | GAGTGAGCA | X | | | |
| 3 3 | 0 | AGGAGTTTC | CAGTT | GAGTGAGGA | X | | | |
| 3 3 | 0 | GGCAGCAGC | CATCA | GAGTGAGGA | X | | | |

| # of mutations | | | (−) site | spacer | (+) site | VF2468 concentration | | |
|---|---|---|---|---|---|---|---|---|
| T (−) | (+) | (−) | | | | 4 nM | 2 nM | 10.5 nM |
| 3 | 3 | 0 | AGCAGGTTG | TTGGAG | GAGTGAGGA | X | | |
| 3 | 3 | 0 | AACAGTGCC | CTGGT | GAGTGAGGA | X | | |
| 3 | 3 | 0 | TGGAGCGTG | GGGGA | GAGTGAGGA | X | | |
| 3 | 3 | 0 | TGGAGCGTG | GAAGAG | GAGTGAGGA | X | | |
| 3 | 3 | 0 | AGCTGAGGC | ACAGG | GAGTGAGGA | X | | |
| 3 | 3 | 0 | TGCAGGGTG | GACCCA | GAGTGAGGA | X | | |
| 3 | 3 | 0 | AACAGAGTG | AGGCT | GAGTGAGGA | X | | |
| 3 | 3 | 0 | AGCAACTTA | TTGCT | GAGTGAGGA | X | | |
| 3 | 3 | 0 | AGCACAATC | TTTTTG | GAGTGAGGA | X | | |
| 3 | 3 | 0 | TGGAGGGTC | GGTGGA | GAGTGAGGA | X | | |
| 3 | 3 | 0 | AGCCGTGTG | GCTACG | GAGTGAGGA | X | | |
| 3 | 3 | 0 | TGCTGCTTC | TGCCGT | GAGTGAGGA | X | | |
| 3 | 3 | 0 | AACAGAGTA | ACACA | GAGTGAGGA | X | | |
| 3 | 3 | 0 | ACCAACTTC | ATGTA | GAGTGAGGA | X | | |
| 3 | 3 | 0 | AGGAGAGTG | AGTGT | GAGTGAGGA | X | | |
| 3 | 3 | 0 | GGCAGGGTG | GCGAAG | GAGTGAGGA | X | | |
| 3 | 3 | 0 | GGCAGGGTG | GCCGGG | GAGTGAGGA | X | | |
| 3 | 3 | 0 | AGCAGGGCT | CCTGGT | GAGTGAGGA | X | | |
| 3 | 3 | 0 | TACAGTGTC | AGCAGT | GAGTGAGGA | X | | |
| 3 | 3 | 0 | ATCACCTTC | TTTCAT | GAGTGAGGA | X | | |
| 3 | 3 | 0 | TTCAGTGTC | TGACGG | GAGTGAGGA | X | | |
| 3 | 3 | 0 | AGCAGCTCA | GGTTAG | GAGTGAGGA | X | | |
| 3 | 3 | 0 | AGGAGAGTA | GGGCT | GAGTGAGGA | X | | |
| 3 | 3 | 0 | ACCTGGGTC | TGAGCA | GAGTGAGGA | X | | |
| 3 | 3 | 0 | ATCAGTGTG | TTTTT | GAGTGAGGA | X | | |
| 3 | 3 | 0 | TGGAGGGTC | AGAGGA | GAGTGAGGA | X | | |
| 3 | 3 | 0 | GGCAGGGTG | CGAGG | GAGTGAGGA | X | | |
| 3 | 3 | 0 | AGGAGAGTG | AATGT | GAGTGAGGA | X | | |
| 3 | 3 | 0 | AGCAGTGCA | CCCAA | GAGTGAGGA | X | | |
| 3 | 3 | 0 | AGCAGGTTG | AAGACT | GAGTGAGGA | X | | |
| 3 | 3 | 0 | AGGAGAGTG | AGAAGT | GAGTGAGGA | X | | |
| 3 | 3 | 0 | AGCAGCCGT | AACAAA | GAGTGAGGA | X | | |
| 3 | 3 | 0 | AGCAGGGCA | GGGCA | GAGTGAGGA | X | | |
| 3 | 3 | 0 | GCCAGCCTC | AGGCT | GAGTGAGGA | X | | |
| 3 | 3 | 0 | AGCAGGGCT | TGGTGG | GAGTGAGGA | X | | |
| 3 | 3 | 0 | AGTAGCAAC | TATTA | GAGTGAGGA | X | | |
| 3 | 3 | 0 | AACAGCGGA | GATTT | GAGTGAGGA | X | | |
| 3 | 3 | 0 | AGGACCATC | CGAGA | GAGTGAGGA | X | | |
| 3 | 3 | 0 | AGGACCATC | CCAGG | GAGTGAGGA | X | | |
| 3 | 3 | 0 | AGGACCATC | CCAGG | GAGTGAGGA | X | | |
| 3 | 3 | 0 | AGGACCATC | CCAGG | GAGTGAGGA | X | | |
| 3 | 3 | 0 | AGCAGGTTA | ACAGG | GAGTGAGGA | X | | |
| 3 | 3 | 0 | TGCAGGGTG | AGCCT | GAGTGAGGA | X | | |
| 3 | 3 | 0 | AGAAGGGTA | GAAAG | GAGTGAGGA | X | | |
| 3 | 3 | 0 | AGATGCGGC | CAGTA | GAGTGAGGA | X | | |
| 3 | 3 | 0 | AATAGGGTC | AGGTAG | GAGTGAGGA | X | | |
| 3 | 3 | 0 | AGCAGTGAA | GGTGG | GAGTGAGGA | X | | |
| 3 | 3 | 0 | AGAAACGTG | GAAAA | GAGTGAGGA | X | | |
| 3 | 3 | 0 | AACAGGGAC | CTTAT | GAGTGAGGA | X | | |
| 3 | 3 | 0 | AGCAAGGAC | TTAAA | GAGTGAGGA | X | | |
| 3 | 3 | 0 | AGCAGATGC | CCTTG | GAGTGAGGA | X | | |
| 3 | 3 | 0 | AGCAGCTGT | GCATA | GAGTGAGGA | X | | |
| 3 | 3 | 0 | AGAAGGGTT | TGTGCA | GAGTGAGGA | X | | |
| 3 | 3 | 0 | AACAGAGTG | GTTTA | GAGTGAGGA | X | | |
| 3 | 3 | 0 | GGCAGTGGC | AGTGG | GAGTGAGGA | X | | |
| 3 | 3 | 0 | AGCACCGAG | CCCCT | GAGTGAGGA | X | | |
| 3 | 3 | 0 | ATCAGCATG | AAATG | GAGTGAGGA | X | | |
| 3 | 3 | 0 | AGCTGTGTG | ACCCT | GAGTGAGGA | X | | |
| 3 | 3 | 0 | TGCAGGGTG | GGAATA | GAGTGAGGA | X | | |
| 3 | 3 | 0 | TGCAGGGTG | TAGTG | GAGTGAGGA | X | | |
| 3 | 3 | 0 | AGGAGGTTC | TGGGAG | GAGTGAGGA | X | | |
| 3 | 3 | 0 | AGGAATGTC | CTGGTC | GAGTGAGGA | X | | |
| 3 | 3 | 0 | AGTAGCTGC | CTTTGG | GAGTGAGGA | X | | |
| 3 | 3 | 0 | AGAAGGGTG | GGAGGG | GAGTGAGGA | X | | |
| 3 | 3 | 0 | AGTAGCTGC | CTTTGG | GAGTGAGGA | X | | |
| 3 | 3 | 0 | AGTAGCTGC | CTTTGG | GAGTGAGGA | X | | |
| 3 | 3 | 0 | AGTAGCTGC | CTTTGG | GAGTGAGGA | X | | |
| 3 | 3 | 0 | AGTAGCTGC | CTTTGG | GAGTGAGGA | X | | |
| 3 | 3 | 0 | AGTAGCTGC | CTTTGG | GAGTGAGGA | X | | |
| 3 | 3 | 0 | AGTAGCTGC | CTTTGG | GAGTGAGGA | X | | |

-continued

| # of mutations | | | | | | VF2468 concentration | | |
|---|---|---|---|---|---|---|---|---|
| T (−) | (+) | (−) site | spacer | (+) site | 4 nM | 2 nM | 10.5 nM |
| 3 3 | 0 | AGTAGAGGC | TGGAG | GAGTGAGGA | X | | |
| 3 3 | 0 | GGCAGCAGC | AATAGA | GAGTGAGGA | X | | |
| 3 3 | 0 | AGCAGCACA | AGCACT | GAGTGAGGA | X | | |
| 3 3 | 0 | TGCATCGTA | AGCAT | GAGTGAGGA | X | | |
| 3 3 | 0 | GGCAGGGTG | GGGGT | GAGTGAGGA | X | | |
| 3 3 | 0 | AGCAGCTGA | AAGAGG | GAGTGAGGA | X | | |
| 3 3 | 0 | TGGAGCGTG | GGAGGA | GAGTGAGGA | X | | |
| 3 3 | 0 | TCCAGGGTC | ACTAAT | GAGTGAGGA | X | | |
| 3 3 | 0 | TGCAGCGAA | AGGCA | GAGTGAGGA | X | | |
| 3 3 | 0 | AGCAGGTTG | GGGAA | GAGTGAGGA | X | | |
| 3 3 | 0 | AGCTGAGGC | TGGCA | GAGTGAGGA | X | | |
| 3 3 | 0 | AACAGTGGC | AAATGA | GAGTGAGGA | X | | |
| 3 3 | 0 | GGCAGTGCC | TGAAGG | GAGTGAGGA | X | | |
| 3 3 | 0 | GGCAGTGCC | TGAAGG | GAGTGAGGA | X | | |
| 3 3 | 0 | GGCAGTGCC | TGAAGG | GAGTGAGGA | X | | |
| 3 3 | 0 | AGGAGAGTA | TGGAG | GAGTGAGGA | X | | |
| 3 3 | 0 | CGCAGCATT | GCAGCG | GAGTGAGGA | X | | |
| 3 3 | 0 | GGAAGTGTC | CTTCAA | GAGTGAGGA | X | | |
| 3 3 | 0 | AGCTGCATA | AGGAAA | GAGTGAGGA | X | | |
| 3 3 | 0 | ACTAGGGTC | TTTGGA | GAGTGAGGA | X | | |
| 3 3 | 0 | AGCTGTGTG | CCAGG | GAGTGAGGA | X | | |
| 3 3 | 0 | ACCACTGTC | AGCTGT | GAGTGAGGA | X | | |
| 3 3 | 0 | GGTAGCTTC | TCCTG | GAGTGAGGA | X | | |
| 3 3 | 0 | AGCAGGGCT | GGGCAG | GAGTGAGGA | X | | |
| 3 3 | 0 | AGCTGTGTG | ATGGGA | GAGTGAGGA | X | | |
| 3 3 | 0 | TGAAGAGTC | CAAGG | GAGTGAGGA | X | | |
| 3 3 | 0 | TGAAGAGTC | CAAGG | GAGTGAGGA | X | | |
| 3 3 | 0 | ACGAGGGTC | CATAG | GAGTGAGGA | X | | |
| 3 3 | 0 | AGAAGCGGT | GGAGT | GAGTGAGGA | X | | |
| 3 3 | 0 | GGCAGAGTT | GTACTG | GAGTGAGGA | X | | |
| 3 3 | 0 | AGCAGTTAC | GGCAAA | GAGTGAGGA | X | | |
| 3 3 | 0 | TGCAGTGTG | CAAGGA | GAGTGAGGA | X | | |
| 3 3 | 0 | CTCTGCGTC | TGGAA | GAGTGAGGA | X | | |
| 3 3 | 0 | AGGAGAGTG | AGAGAA | GAGTGAGGA | X | | |
| 3 3 | 0 | AGGAGAGTG | AGAGAA | GAGTGAGGA | X | | |
| 3 3 | 0 | AATAGGGTC | AGGTAG | GAGTGAGGA | X | | |
| 4 0 | 4 | AGCAGCGTC | TCCGAA | GACTCATGT | X | | |
| 4 0 | 4 | AGCAGCGTC | ACATAA | TAGTGGAGC | X | | |
| 4 0 | 4 | AGCAGCGTC | CAGGA | GTGGAGTC | X | | |
| 4 0 | 4 | AGCAGCGTC | TGGTCT | GGCGGAGGC | X | | |
| 4 0 | 4 | AGCAGCGTC | TTAGA | AGGTGACAA | X | | |
| 4 0 | 4 | AGCAGCGTC | AGAGGA | GGGAGACCA | X | | |
| 4 0 | 4 | AGCAGCGTC | ACTGGT | AAGACATGA | X | | |
| 4 0 | 4 | AGCAGCGTC | CCTGG | CATGGAGCA | X | | |
| 4 0 | 4 | AGCAGCGTC | TGACAG | CAGTGAAAC | X | | |
| 4 0 | 4 | AGCAGCGTC | TCCAGG | GTGTGCTGC | X | | |
| 4 0 | 4 | AGCAGCGTC | TCAGA | GGTAGAGCA | X | | |
| 4 0 | 4 | AGCAGCGTC | GAGACC | CATGGAGCA | X | | |
| 4 0 | 4 | AGCAGCGTC | GTGGC | AGGGCAGGA | X | | |
| 4 0 | 4 | AGCAGCGTC | CTGGG | GAGCGCGTC | X | | |
| 4 0 | 4 | AGCAGCGTC | GTTCGG | GGCTGAGAT | X | | |
| 4 0 | 4 | AGCAGCGTC | AGGCT | GTGGGAGCC | X | | |
| 4 0 | 4 | AGCAGCGTC | CACTG | TGGTAAGCA | X | | |
| 4 0 | 4 | AGCAGCGTC | TGCATG | GTGTGTTGC | X | | |
| 4 0 | 4 | AGCAGCGTC | TAATAC | AATTGAGTT | X | | |
| 4 0 | 4 | AGCAGCGTC | AACTGT | GTGAGTTGA | X | | |
| 4 0 | 4 | AGCAGCGTC | AAGTCT | GTGTGCTGC | X | | |
| 4 0 | 4 | AGCAGCGTC | TACAGT | GACTGCCGT | X | | |
| 4 0 | 4 | AGCAGCGTC | TGTGC | CATGGAGCA | X | | |
| 4 0 | 4 | AGCAGCGTC | TCCTT | GAGCGGTGC | X | | |
| 4 0 | 4 | AGCAGCGTC | TCCTTG | GGCAGAGGT | X | | |
| 4 0 | 4 | AGCAGCGTC | ACGTG | CCGCTAGGA | X | | |
| 4 1 | 3 | AGCCGCGTC | GCGGA | GAGGGCGGC | X | | |
| 4 1 | 3 | AGCAGTGTC | CTGAGG | GTGTGAAGG | X | | |
| 4 1 | 3 | AGCAGTGTC | AGATT | AAGTGAGCC | X | | |
| 4 1 | 3 | AGCATCGTC | AATTA | CAGTGAAAA | X | | |
| 4 1 | 3 | AGCAGCGGC | TGTGG | CAGTGTGGT | X | | |
| 4 1 | 3 | AGCAACGTC | GTGACA | GAGCCTGGA | X | | |
| 4 1 | 3 | AGCAGTGTC | ACAGT | GTGTGAGAG | X | | |
| 4 1 | 3 | AGCAGCGGC | TCCCAG | GAGAGGGGC | X | | |
| 4 1 | 3 | AGCAACGTC | AGCAAA | GTCTCAGGA | X | | |

| # of mutations | | | | | | VF2468 concentration | | |
|---|---|---|---|---|---|---|---|---|
| T (−) | (+) | (−) site | spacer | (+) site | 4 nM | 2 nM | 10.5 nM |
| 4 | 1 | 3 | AGCAACGTC | AGCAAA | GTCTCAGGA | X | | |
| 4 | 1 | 3 | AGTAGCGTC | TCGCT | GTGTGAGTG | X | | |
| 4 | 1 | 3 | AGCAACGTC | AGCAGA | GTCTCAGGA | X | | |
| 4 | 1 | 3 | AGCAGCGTT | ATTCT | GAGTGATAT | X | | |
| 4 | 1 | 3 | AGCAGTGTC | CAGTA | GTGTAAGGT | X | | |
| 4 | 1 | 3 | AGCAACGTC | AGCAAA | GTCTCAGGA | X | | |
| 4 | 1 | 3 | AGCAACGTC | AGCAAA | GTCTCAGGA | X | | |
| 4 | 1 | 3 | GGCAGCGTC | GGGATA | TGGTGAGGG | X | | |
| 4 | 1 | 3 | AGCAACGTC | AGCAAA | GTCTCAGGA | X | | |
| 4 | 1 | 3 | AGCAGAGTC | GCTCA | CTGTGAGGC | X | | |
| 4 | 1 | 3 | AGCAGCGGC | AGCGGC | GAGGGCGGC | X | | |
| 4 | 1 | 3 | AGCAGTGTC | AGAGCA | GAGAGAGCC | X | | |
| 4 | 1 | 3 | AGCATCGTC | TGATCC | TTGTGAGGG | X | | |
| 4 | 1 | 3 | AGCAACGTC | AGCAAA | GTCTCAGGA | X | | |
| 4 | 1 | 3 | AGCAACGTC | AGCAAA | GTCTCAGGA | X | | |
| 4 | 1 | 3 | AGCAGGGTC | TCCTG | TAGTGAGTC | X | | |
| 4 | 1 | 3 | ACCAGCGTC | TGCTTC | TGGTGAGGC | X | | |
| 4 | 1 | 3 | AGCAACGTC | AGCAAA | GTCTCAGGA | X | | |
| 4 | 1 | 3 | AGCAGCATC | AGCTG | GAGGAAGGG | X | | |
| 4 | 1 | 3 | AGCAGCGGC | AACGAT | GAGCAAGAA | X | | |
| 4 | 1 | 3 | AGCAGTGTC | AGCAGC | AAGTGTGGT | X | | |
| 4 | 1 | 3 | AGCAACGTC | AGCAAA | GTCTCAGGA | X | | |
| 4 | 1 | 3 | AGCAGCGGC | CACAGA | GGTTGAGGC | X | | |
| 4 | 1 | 3 | AGCAGCGGC | ACCTG | GGGAGAGGC | X | | |
| 4 | 1 | 3 | AGCAGTGTC | AGTGGT | GGAGGAGGA | X | | |
| 4 | 1 | 3 | AGCAACGTC | AGCAAA | GTCTCAGGA | X | | |
| 4 | 1 | 3 | AGCAGAGTC | CTGGGA | GACTGAACA | X | | |
| 4 | 1 | 3 | AGCAGTGTC | AGATA | GAGGGAGCC | X | | |
| 4 | 1 | 3 | AGCAGTGTC | CATTTG | AAGGGAGGT | X | | |
| 4 | 1 | 3 | TGCAGCGTC | TGTGT | GAGTGTCGT | X | | |
| 4 | 1 | 3 | GGCAGCGTC | TGTCT | GTGTGAGCT | X | | |
| 4 | 1 | 3 | AGCAGCGTG | TTTTAA | GAGTGAAAG | X | | |
| 4 | 1 | 3 | AGCAGCGGC | TGTGAA | AGGTGAGGT | X | | |
| 4 | 1 | 3 | AGCAGTGTC | CAGGA | GGAGGAGGA | X | | |
| 4 | 1 | 3 | AGCAGTGTC | TTGCAT | GTGGGAGGT | X | | |
| 4 | 1 | 3 | ACCAGCGTC | TGCTTC | TGGTGAGGC | X | | |
| 4 | 1 | 3 | AGCAACGTC | CATCCT | GAGAGATGG | X | | |
| 4 | 1 | 3 | AGCAACGTC | AGCAAA | GTCTCAGGA | X | | |
| 4 | 1 | 3 | AGCAACGTC | ACAGGT | GAGTTGAGA | X | | |
| 4 | 1 | 3 | AGCAACGTC | CAGAA | AATTGAGCA | X | | |
| 4 | 1 | 3 | AGCAGTGTC | TTTTT | GAGTAGGCA | X | | |
| 4 | 1 | 3 | AGCAGCGGC | AGCAT | TAGGGAGGT | X | | |
| 4 | 1 | 3 | AGCAGTGTC | CTCATG | GGAGGAGGA | X | | |
| 4 | 1 | 3 | AGCAGCGGC | CAAGA | GAGTGAATT | X | | |
| 4 | 1 | 3 | AGCAACGTC | AGCAAA | GTCTCAGGA | X | | |
| 4 | 1 | 3 | AGCAGAGTC | AGGGA | GACTGAGTC | X | | |
| 4 | 1 | 3 | AGCAGTGTC | CAGCGT | GAGGGAGAT | X | | |
| 4 | 1 | 3 | AGCACCGTC | TGGGA | GTATGAGGC | X | | |
| 4 | 1 | 3 | ACCAGCGTC | CACTTC | TGGTGAGGC | X | | |
| 4 | 1 | 3 | AGCAACGTC | AGCAAA | GTCTCAGGA | X | | |
| 4 | 1 | 3 | AGCAACGTC | AGCAAA | GTCTCAGGA | X | | |
| 4 | 1 | 3 | AGCAACGTC | AGAAAA | GTCTCAGGA | X | | |
| 4 | 1 | 3 | AGCAGGGTC | CAAAA | GAGTGATTT | X | | |
| 4 | 1 | 3 | AGCAGTGTC | AGCCCA | GAGTGAATT | X | | |
| 4 | 1 | 3 | AGCAACGTC | AGCAAA | GTCTCAGGA | X | | |
| 4 | 1 | 3 | AGCAACGTC | AGCAAA | GTCTCAGGA | X | | |
| 4 | 1 | 3 | AGCAGTGTC | AACTAG | GAGTAGGCA | X | | |
| 4 | 1 | 3 | AGCAGCGGC | ATTAC | GAGTAAGCT | X | | |
| 4 | 1 | 3 | AGCAACGTC | AGCAAA | GTCTCAGGA | X | | |
| 4 | 1 | 3 | AGCAACGTC | AACAAA | GTCTCAGGA | X | | |
| 4 | 1 | 3 | AGCAGCTTC | CTCTG | GGGAGTGGA | X | | |
| 4 | 1 | 3 | AGCAGTGTC | TCCCC | GAGGGAAAA | X | | |
| 4 | 1 | 3 | AGCATCGTC | CGGGG | AGGTGAGAA | X | | |
| 4 | 1 | 3 | AGCAGCGGC | TCTCA | AAGTGTGGT | X | | |
| 4 | 1 | 3 | AGCATCGTC | CGGGG | AGGTGAGAA | X | | |
| 4 | 1 | 3 | AGCAGCGTT | CACACT | CAGAGAGGT | X | | |
| 4 | 1 | 3 | AGCAGCGGC | CGGAGC | AAGAGAGGG | X | | |
| 4 | 1 | 3 | AACAGCGTC | AATGT | GTGTGAGAG | X | | |
| 4 | 1 | 3 | AGCATCGTC | CGGGG | AGGTGAGAA | X | | |
| 4 | 1 | 3 | AGCATCGTC | CGGGG | AGGTGAGAA | X | | |
| 4 | 1 | 3 | AGCATCGTC | TGGGG | AGGTGAGAA | X | | |

| # of mutations | | | | | | VF2468 concentration | | |
|---|---|---|---|---|---|---|---|---|
| T (−) | (+) | (−) site | spacer | (+) site | | 4 nM | 2 nM | 10.5 nM |
| 4 | 1 | 3 AGCATCGTC | CGGGG | AGGTGAGAA | | X | | |
| 4 | 1 | 3 AGCAGCATC | AGCGA | GAGGAAGGG | | X | | |
| 4 | 1 | 3 AGCAACGTC | AGCAAA | GTCTCAGGA | | X | | |
| 4 | 1 | 3 AGCACCGTC | CAGTGT | GGGTGAAGC | | X | | |
| 4 | 1 | 3 AGCAACGTC | AGCAAA | GTCTCAGGA | | X | | |
| 4 | 1 | 3 AACAGCGTC | AACGT | GAGTGAATT | | X | | |
| 4 | 1 | 3 AGCAACGTC | AGCAAA | GTCTCAGGA | | X | | |
| 4 | 1 | 3 AGCAACGTC | AGCAAA | GTCTCAGGA | | X | | |
| 4 | 1 | 3 AGCACCGTC | TCCTGA | GGGTGAGTG | | X | | |
| 4 | 1 | 3 AGCACCGTC | CTTTCC | GTGTGGGGT | | X | | |
| 4 | 1 | 3 AGCAGGGTC | AAAAAG | TAGTGTTGA | | X | | |
| 4 | 1 | 3 AGCAACGTC | CCTCAT | GAATAAAGA | | X | | |
| 4 | 1 | 3 AGCAACGTC | AGCAAA | GTCTCAGGA | | X | | |
| 4 | 1 | 3 AGCAGCTTC | TCTGA | GGGAGTGGA | | X | | |
| 4 | 1 | 3 GGCAGCGTC | TGGGAT | GAGGAAGGC | | X | | |
| 4 | 1 | 3 AGCAACGTC | AGCAAA | GTCTCAGGA | | X | | |
| 4 | 1 | 3 AGCAGCGGC | AACTT | AAGAGTGGA | | X | | |
| 4 | 1 | 3 AGCAGCGGC | CTCAG | AAGTGAGCC | | X | | |
| 4 | 1 | 3 AGCAGTGTC | TGCACA | GAGTAGGCA | | X | | |
| 4 | 1 | 3 AGCAGTGTC | CCGAGG | CTGTGAGGC | | X | | |
| 4 | 1 | 3 AGCAACGTC | AGCAAA | GTCTCAGGA | | X | | |
| 4 | 1 | 3 AGCAACGTC | AGCAAA | GTCTCAGGA | | X | | |
| 4 | 1 | 3 AGCAGTGTC | CAGCA | CAGTGAGAT | | X | | |
| 4 | 1 | 3 AGCAACGTC | CAGAGG | GAGGAAAGA | | X | | |
| 4 | 1 | 3 AGCAGCGTG | TTAATT | AAGTGAGTC | | X | | |
| 4 | 1 | 3 AGCAGGGTC | TAAGG | GAGTGATTT | | X | | |
| 4 | 1 | 3 AGCACCGTC | TGGGA | GTTTCAGGA | | X | | |
| 4 | 1 | 3 AGCACCGTC | TGGGA | GTTTCAGGA | | X | | |
| 4 | 1 | 3 ATCAGCGTC | CAGCGT | GAGGTAGGC | | X | | |
| 4 | 1 | 3 AGCATCGTC | AATTA | TAGTGAGAC | | X | | |
| 4 | 1 | 3 AGCAACGTC | AGCAAA | GTCTCAGGA | | X | | |
| 4 | 1 | 3 AGCAGCGAC | ATCCT | GAGTGGGCT | | X | | |
| 4 | 1 | 3 AGCACCGTC | CAGACA | GAGCAGGGA | | X | | |
| 4 | 1 | 3 AGCAGTGTC | ATTTTC | TGGTGAGGG | | X | | |
| 4 | 1 | 3 AGCAGTGTC | CTGTG | GAGTGTTGG | | X | | |
| 4 | 1 | 3 AGCAGCGGC | GAGGT | TAGTGTGGT | | X | | |
| 4 | 1 | 3 AGCAGGGTC | CACAGT | GTGTGAGAT | | X | | |
| 4 | 2 | 2 AGCACCGGC | CGGCC | GAGGGAGGG | | X | | |
| 4 | 2 | 2 AGCAGAGTG | CCAGG | GAGTGAGAT | | X | | |
| 4 | 2 | 2 AGCAAGGTC | TGCATT | GAGAGAGGC | | X | | |
| 4 | 2 | 2 AGCATGGTC | CAGCA | GAGTGAGCC | | X | | |
| 4 | 2 | 2 ATCAGTGTC | ATCCTG | GAGTAAGGT | | X | | |
| 4 | 2 | 2 AGCATGGTC | GTGGA | AAGTGAGTA | | X | | |
| 4 | 2 | 2 AGCAATGTC | TGTGG | GAGGGAGGC | | X | | |
| 4 | 2 | 2 AGCATTGTC | TGCAGT | GAGTGTGGG | | X | | |
| 4 | 2 | 2 AGCATTGTC | TCCCTC | CAGTGAGGG | | X | | |
| 4 | 2 | 2 AGCAAGGTC | AGTGTC | TAGTGAGGG | | X | | |
| 4 | 2 | 2 AGCAGGGTA | GTGGT | GAGTAAGGT | | X | | |
| 4 | 2 | 2 AGCAGCGCA | GGCCG | GGGTGAGGG | | X | | |
| 4 | 2 | 2 AGCAGCATT | GACAT | GAGTGAGAT | | X | | |
| 4 | 2 | 2 AGCATGGTC | AGGTTC | CAGTGAGGG | | X | | |
| 4 | 2 | 2 AGCTGCATC | ACCTT | GAGTGAGTC | | X | | |
| 4 | 2 | 2 AGAAACGTC | CAGGTA | GAGTGAAAA | | X | | |
| 4 | 2 | 2 TGCAGTGTC | CCATG | GAGGGAGGT | | X | | |
| 4 | 2 | 2 AACAACGTC | CAGCAG | GAGTGTGAA | | X | | |
| 4 | 2 | 2 AGCAAGGTC | TTAAA | GAGCGAGTA | | X | | |
| 4 | 2 | 2 AGCAGTGTG | GGGCA | GTGTGAGGC | | X | | |
| 4 | 2 | 2 AGTAGTGTC | CTGTG | GAGGGAGGC | | X | | |
| 4 | 2 | 2 AGCAGGGTT | GGTTTC | TAGTGAGGC | | X | | |
| 4 | 2 | 2 AGCATGGTC | AGGTTC | CAGTGAGGG | | X | | |
| 4 | 2 | 2 AGCAGCATT | GACAT | GAGTGAGAT | | X | | |
| 4 | 2 | 2 AGCACCGTA | TTCTGC | TAGTGAGGG | | X | | |
| 4 | 2 | 2 AGCTGTGTC | TGGTGT | GAGTGAGAG | | X | | |
| 4 | 2 | 2 AGCCGGGTC | CCCAC | GAGTGAGTG | | X | | |
| 4 | 2 | 2 AACAGGGTC | AGAGAA | GAGTGAGAC | | X | | |
| 4 | 2 | 2 AGCACTGTC | TTGGA | AAGTGAGGG | | X | | |
| 4 | 2 | 2 AGCAACGTG | GCAGAG | GAGGGAGGT | | X | | |
| 4 | 2 | 2 AGCAGGGTG | GGAACT | GAGGGAGGT | | X | | |
| 4 | 2 | 2 AGCACAGTC | TTGGG | GAGAGAGGC | | X | | |
| 4 | 2 | 2 AGCATTGTC | ACACA | GAGTGAATA | | X | | |
| 4 | 2 | 2 ATCAGAGTC | AGCTTA | GAGTGAGAG | | X | | |

| # of mutations | | | | | | VF2468 concentration | | |
|---|---|---|---|---|---|---|---|---|
| T (−) | (+) | (−) site | spacer | (+) site | | 4 nM | 2 nM | 10.5 nM |
| 4 | 2 | 2 AGCAACCTC | CAGGT | GAGGGAGGC | | X | | |
| 4 | 2 | 2 AGCGGAGTC | GCTGGG | GAGAGAGGG | | X | | |
| 4 | 2 | 2 AGCATGGTC | CATTTC | TAGTGAGGC | | X | | |
| 4 | 2 | 2 TGCAGTGTC | CACAGC | AAGTGAGGT | | X | | |
| 4 | 2 | 2 GGCACCGTC | CTCCTG | GAGGGAGGC | | X | | |
| 4 | 2 | 2 AGCAAAGTC | TCTAAA | GAGTGTGGT | | X | | |
| 4 | 2 | 2 AGCAGCATT | GACAT | GAGTGAGAT | | X | | |
| 4 | 2 | 2 AGCAGCATT | GCACGG | GGGTGAGGT | | X | | |
| 4 | 2 | 2 AGCAGTGAC | AGCGG | GAGTGAGCC | | X | | |
| 4 | 2 | 2 AGCAGTGAC | CAATCT | GAGTGAGCC | | X | | |
| 4 | 2 | 2 AGCAATGTC | AACAGA | GGGTGAGGG | | X | | |
| 4 | 2 | 2 AGCAACATC | TACTAA | GAGTGAGCC | | X | | |
| 4 | 2 | 2 TGCAGGGTC | AGGGT | GTGTGAGGC | | X | | |
| 4 | 2 | 2 AGCAACGGC | GACTG | GAGTGACCA | | X | | |
| 4 | 2 | 2 AGCATGGTC | CAGTTC | CAGTGAGGG | | X | | |
| 4 | 2 | 2 GGCAGTGTC | CTCCCA | CAGTGAGGC | | X | | |
| 4 | 2 | 2 AGCACCGGC | CCTGGG | CAGTGAGGG | | X | | |
| 4 | 2 | 2 AACAGTGTC | TATAAA | TAGTGAGGG | | X | | |
| 4 | 2 | 2 AGCAAAGTC | AGAGG | GAGTGATGT | | X | | |
| 4 | 2 | 2 AGCAATGTC | TGCAT | GAGGGAGGT | | X | | |
| 4 | 2 | 2 AGCAGTCTC | CAGGC | GAGAGAGGG | | X | | |
| 4 | 2 | 2 AGCAAAGTC | CTTGGT | AAGTGAGGG | | X | | |
| 4 | 2 | 2 AGCAGCAGC | TTAGA | GAGTGAGCC | | X | | |
| 4 | 2 | 2 AACATCGTC | AGTGG | GAGTGTGAA | | X | | |
| 4 | 2 | 2 AGCAACATC | CTTGGG | GAGTGAAGT | | X | | |
| 4 | 2 | 2 AGCCCCGTC | AAGCA | GAGGGAGGC | | X | | |
| 4 | 2 | 2 AGCAGCGGT | TCTCA | GAGTGTGGC | | X | | |
| 4 | 2 | 2 AGCAAGGTC | TGAGAA | GAGTGGTGA | | X | | |
| 4 | 2 | 2 AACAGAGTC | AGAGAG | GTGTGAGGC | | X | | |
| 4 | 2 | 2 GGCAGCGTG | TGACAG | AAGTGAGGG | | X | | |
| 4 | 2 | 2 AGCATAGTC | TCCCA | GAGTGAGTG | | X | | |
| 4 | 2 | 2 AGCCGTGTC | CCCTT | AAGTGAGGG | | X | | |
| 4 | 2 | 2 AGCATGGTC | AGGTT | CAGTGAGGG | | X | | |
| 4 | 2 | 2 AGTAGTGTC | TGGTG | GAGTGAGTT | | X | | |
| 4 | 2 | 2 AGCAGCATT | GACAT | GAGTGAGAT | | X | | |
| 4 | 2 | 2 AGCAGCATT | TCAAGA | GAGTGAGAG | | X | | |
| 4 | 2 | 2 CGCAGTGTC | TGGTCA | CAGTGAGGC | | X | | |
| 4 | 2 | 2 AGCAGGGTG | GGGAA | GAGGGAGGT | | X | | |
| 4 | 2 | 2 AGCAGGGTA | ATGTGA | GAGTGAGTG | | X | | |
| 4 | 2 | 2 AGCATAGTC | ACTTA | GAGTGTGGG | | X | | |
| 4 | 2 | 2 AGCATGGTC | AGGTTC | CAGTGAGGG | | X | | |
| 4 | 2 | 2 TCCAGCGTC | GTGACA | GAGTGAGAC | | X | | |
| 4 | 2 | 2 AGCACTGTC | CTGTCA | GAGTGTGGC | | X | | |
| 4 | 2 | 2 AGCATAGTC | CAGTT | CAGTGAGGC | | X | | |
| 4 | 2 | 2 AGCAGTGTG | CACCAC | GAGAGAGGC | | X | | |
| 4 | 2 | 2 AGCAACGGC | AGGAGA | GAGAGGGGA | | X | | |
| 4 | 2 | 2 AGCCGGGTC | ACCGA | GAGTGAGTG | | X | | |
| 4 | 2 | 2 AGCAATGTC | AATTTT | CAGTGAGCA | | X | | |
| 4 | 2 | 2 AGCAACGTG | TGGAG | CAGTGAGGG | | X | | |
| 4 | 2 | 2 AGCACGGTC | AGTCTT | CAGTGAGGG | | X | | |
| 4 | 2 | 2 AGCATGGTC | ATGTTA | TAGTGAGTA | | X | | |
| 4 | 2 | 2 AGCAGGGTA | GGGAG | GAGTGAGTG | | X | | |
| 4 | 2 | 2 AGCGGTGTC | TGAAAA | AAGTGAGGG | | X | | |
| 4 | 2 | 2 AGCAAGGTC | CATCCA | GAGAGAGGC | | X | | |
| 4 | 2 | 2 AGCACCTTC | TAGGGA | GTGTGAGGC | | X | | |
| 4 | 2 | 2 AGCAAAGTC | TCACAG | GAGGGAGGC | | X | | |
| 4 | 2 | 2 AGCAAGGTC | TGGGA | GAGTGATGT | | X | | |
| 4 | 2 | 2 AGCAGCAGC | TGCCGG | GAGCGAGGC | | X | | |
| 4 | 2 | 2 AGCAACCTC | CTGGG | GAGTGTGGG | | X | | |
| 4 | 2 | 2 TGCAGCGAC | TGAAGT | GAGTGAGTG | | X | | |
| 4 | 2 | 2 GGCAGCTTC | CCAGT | GAGTAAGGT | | X | | |
| 4 | 2 | 2 AACAGTGTC | AGTGAT | TAGTGAGGG | | X | | |
| 4 | 2 | 2 AGCTTCGTC | CAGAG | CAGTGAGGG | | X | | |
| 4 | 2 | 2 AGCAGCATT | GACAT | GAGTGAGAT | | X | | |
| 4 | 2 | 2 AGCAACGTG | ATGAAA | GAGTGAGAT | | X | | |
| 4 | 2 | 2 AGCAATGTC | AGTCTC | AAGTGTGGA | | X | | |
| 4 | 2 | 2 TGCAGTGTC | CCTGG | GAGGGAGGT | | X | | |
| 4 | 2 | 2 AGCAACGGC | CAGTCC | CAGGGAGGA | | X | | |
| 4 | 2 | 2 AGCATCGGC | TCCTC | AAGTGAGGC | | X | | |
| 4 | 2 | 2 AGCATCGGC | TCCTC | AAGTGAGGC | | X | | |
| 4 | 2 | 2 AGCATCGGC | TCCTC | AAGTGAGGC | | X | | |

| # of mutations T (−) (+) (−) | site | spacer | (+) site | VF2468 concentration 4 nM | 2 nM | 10.5 nM |
|---|---|---|---|---|---|---|
| 4 2 2 | AGCAAGGTC | AGAGA | GTGTGAGGC | X | | |
| 4 2 2 | AGCGGAGTC | CAGAG | AAGTGAGGG | X | | |
| 4 2 2 | AGCACCATC | AGCAC | CAGTGAGGT | X | | |
| 4 2 2 | AGCTGCTTC | CCCTA | GAGTGAGAG | X | | |
| 4 2 2 | AGCAACATC | ACTTT | GAGTAAGGC | X | | |
| 4 2 2 | AACAGTGTC | AAATC | AAGTGAGGT | X | | |
| 4 2 2 | AGCATCGTA | CCTCAA | GAGACAGGA | X | | |
| 4 2 2 | AGCATGGTC | GGTTTC | CAGTGAGGG | X | | |
| 4 2 2 | AACAGCTTC | CCAGCT | TAGTGAGGC | X | | |
| 4 2 2 | AGCAACTTC | CCTGGA | GGGTGAGGG | X | | |
| 4 2 2 | AGCAGCATT | GACAT | GAGTGAGAT | X | | |
| 4 2 2 | AGCAGGGTG | GGGTGT | GAGGGAGGC | X | | |
| 4 2 2 | AGCATTGTC | TGAAG | GAGAGGGGA | X | | |
| 4 2 2 | GGCAGCGTG | TGTGA | GAGTGAGCT | X | | |
| 4 2 2 | AGCTGTGTC | CCCCA | GAGTGAGAG | X | | |
| 4 2 2 | AGCAGCATT | CATGT | GAGTGAGAT | X | | |
| 4 2 2 | AGCAGTGTT | TCTCT | GAGTGTGGC | X | | |
| 4 2 2 | AGCACAGTC | ACCCA | TAGTGAGGC | X | | |
| 4 2 2 | GGCAGCTTC | AGGGC | AAATGAGGA | X | | |
| 4 2 2 | AGCATTGTC | ATAATA | GAGAGAGGT | X | | |
| 4 2 2 | AGCATGGTC | ATGGA | AAGTGAGTA | X | | |
| 4 2 2 | AGCAGGGTG | GTAAA | GAGGGAGGT | X | | |
| 4 2 2 | AGCAACTTC | TCCAC | TAGTGAGGG | X | | |
| 4 2 2 | AGCAGCAGC | CGGTG | GTGTGAGGC | X | | |
| 4 2 2 | TGCAGGGTC | TCTTA | GAGTGAGTT | X | | |
| 4 2 2 | TGCAGCGTT | GGGCT | CAGTGAGGG | X | | |
| 4 2 2 | AGCAGCATA | TAATA | GAGTGAGTC | X | | |
| 4 2 2 | AGCAGTGTG | CTAAG | GAGAGAGGC | X | | |
| 4 2 2 | AACAGCATC | TCAGCT | GGGTGAGGC | X | | |
| 4 2 2 | AGCAGTGTG | CCTTGG | GTGTGAGGG | X | | |
| 4 2 2 | AACAGAGTC | GTTCA | GTGTGAGGG | X | | |
| 4 2 2 | AGCAACGTT | AGCAG | GAGTGTGGT | X | | |
| 4 2 2 | AGCAAAGTC | TGTAAA | GAGTGTGTA | X | | |
| 4 2 2 | TGCATCGTC | CTATG | GAGGGAGGT | X | | |
| 4 2 2 | AGCAAGGTC | TTGTTG | GAGGGAGGG | X | | |
| 4 2 2 | GGCACCGTC | ATCCT | GAGTGGGGC | X | | |
| 4 2 2 | AGCAGAGTA | AGGGAG | GAGTGAGAG | X | | |
| 4 2 2 | AGCAAAGTC | ACAGG | GAGTGAGCG | X | | |
| 4 2 2 | AGAAGTGTC | ACTGTC | CAGTGAGGC | X | | |
| 4 2 2 | AGCAGCATT | GACAT | GAGTGAGAT | X | | |
| 4 2 2 | AGCAAAGTC | AGCCA | GAGGGAGAA | X | | |
| 4 2 2 | AGCAAAGTC | TGGAGT | GAGTGTGTA | X | | |
| 4 2 2 | GGCAGTGTC | CGGCT | GAGGGAGGG | X | | |
| 4 2 2 | AGCAGCAAC | AGTGT | GAGTGAGTT | X | | |
| 4 2 2 | AGCATTGTC | TAGCA | GGGTGAGAA | X | | |
| 4 2 2 | AGCAAGGTC | ACTGAG | GAGGGAGGC | X | | |
| 4 2 2 | AGCATCGGC | AGCTTG | GAGAGAGGT | X | | |
| 4 2 2 | AGCAGGGTG | GTAGGG | GAGGGAGGT | X | | |
| 4 2 2 | AGCAGCGCT | TCTCA | AAGTGAGGC | X | | |
| 4 2 2 | AGCAGGGTG | GTGTGA | GAGTGAGTG | X | | |
| 4 2 2 | TGCAGCGTG | GCCACA | GAGTGAGAC | X | | |
| 4 2 2 | TGCAGTGTC | ATTTGA | GAGTAAGGT | X | | |
| 4 2 2 | AGCAGGGTG | AGCACT | AAGTGAGGC | X | | |
| 4 2 2 | AACAGGGTC | AGTGGG | GAGAGAGGC | X | | |
| 4 2 2 | AACAGCGGC | CTATT | GTGTGAGGG | X | | |
| 4 2 2 | AGCAACGTT | CAGCT | CAGTGAGGT | X | | |
| 4 2 2 | AGCAGTGTT | GCCCCA | GGGTGAGGT | X | | |
| 4 2 2 | AGCACCGTG | TGGGA | GAGGGAGGT | X | | |
| 4 2 2 | AGCAACGTT | CTGTG | GAATGAGCA | X | | |
| 4 2 2 | AGCCACGTC | GAATG | GATTGAGGG | X | | |
| 4 2 2 | AGCAGGGTG | GAGCGC | GAGGGAGGC | X | | |
| 4 2 2 | TGCAGCGGC | CTCAG | AAGTGAGGG | X | | |
| 4 2 2 | AGCATTGTC | TCCCTT | GAGTATGGA | X | | |
| 4 2 2 | GGCACCGTC | CTTTG | CAGTGAGGT | X | | |
| 4 2 2 | AGCATGGTC | GGGCAC | TAGTGAGGC | X | | |
| 4 2 2 | AGCACCTTC | ATGAAT | GTGTGAGGC | X | | |
| 4 2 2 | AGTAGTGTC | TAATAG | GTGTGAGGT | X | | |
| 4 2 2 | AGCACCATC | AAGATA | GTGTGAGGC | X | | |
| 4 2 2 | AGCCACGTC | ACCTG | AGGTGAGGA | X | | |
| 4 2 2 | AGCAACATC | TGTGTA | GAGCGAGGT | X | | |
| 4 2 2 | AGCCGAGTC | CTTGT | GGGTGAGGC | X | | |

| # of mutations T (-) (+) (-) | site | spacer | (+) site | VF2468 concentration 4 nM | 2 nM | 10.5 nM |
|---|---|---|---|---|---|---|
| 4 2 2 | ACCAGTGTC | CTGCAG | TAGTGAGGC | X | | |
| 4 2 2 | AGCAACGAC | GGGCT | GCGTGTGGA | X | | |
| 4 2 2 | AGCAGCATT | GACCT | GAGTGAGAT | X | | |
| 4 2 2 | AGCAGCATT | GACCT | GAGTGAGAT | X | | |
| 4 2 2 | CGCAGTGTC | TTCCC | CAGTGAGGC | X | | |
| 4 2 2 | TGCATCGTC | AGAGA | GTGTGAGGG | X | | |
| 4 2 2 | AGCTGAGTC | CCCGGC | AAGTGAGGC | X | | |
| 4 2 2 | AGCAACGTG | TGCCA | GTGTGAGGG | X | | |
| 4 2 2 | AGCAGTGGC | TGGGCA | TAGTGAGGC | X | | |
| 4 2 2 | AGCAGCATT | GACAT | GAGTGAGAT | X | | |
| 4 2 2 | AGCACCATC | TAGGCA | GAGGGAGGC | X | | |
| 4 2 2 | AGCACAGTC | ATGGTG | GAGTAAGGG | X | | |
| 4 2 2 | AGCATGGTC | AGGTTC | CAGTGAGGG | X | | |
| 4 2 2 | AGCATGGTC | AGGTTC | CAGTGAGGG | X | | |
| 4 2 2 | AGTAACGTC | ATTTCA | GAGTGCAGA | X | | |
| 4 2 2 | AGCAACTTC | TAGGAT | GAGTGTGAA | X | | |
| 4 2 2 | AGCAGCATT | GACAT | GAGTGAGAT | X | | |
| 4 2 2 | AGCAATGTC | TGCTGT | GGGTGAGGG | X | | |
| 4 2 2 | AGCAATGTC | TGCCAT | GAGTGTGAA | X | | |
| 4 2 2 | AGCAGATTC | GGAATT | GAGTGAGTG | X | | |
| 4 2 2 | CACAGCGTC | GGAGG | GAGGGAGGG | X | | |
| 4 2 2 | AGCAGCGAT | CTAAT | GAGGGAGAA | X | | |
| 4 2 2 | AGCACCGTG | AGACTT | GAGTGAGCC | X | | |
| 4 2 2 | ATCAGTGTC | CTGGG | GAGTGTGGT | X | | |
| 4 2 2 | AGCAACCTC | ACGGG | GAGGGAGGC | X | | |
| 4 2 2 | AGCAACTTC | AGAAGT | GAGTTAGGG | X | | |
| 4 2 2 | AGCAACTTC | CACTA | GAGAGAGGC | X | | |
| 4 2 2 | AGCAACGTG | GCAGAT | GAGAGAGGT | X | | |
| 4 2 2 | AACAGCATC | AAATGC | GGGTGAGGC | X | | |
| 4 2 2 | ACAAGCGTC | TGTAA | GAGTGAGTC | X | | |
| 4 2 2 | TCCAGCGTC | ACCTA | AAGTGAGGG | X | | |
| 4 2 2 | AGCAAGGTC | AGGAA | GAGAGAGGC | X | | |
| 4 2 2 | AGTAGCGTT | TTGTC | CAGTGAGGT | X | | |
| 4 2 2 | AGCAGTGTT | TGCTAA | CAGTGAGGC | X | | |
| 4 2 2 | AGCATGGTC | AGGTTC | CAGTGAGGG | X | | |
| 4 2 2 | AGCAGCGGA | GGTCA | GAGTGAGTT | X | | |
| 4 2 2 | AGCACCGAC | TCCAT | CAGTGAGGT | X | | |
| 4 2 2 | AGCAGTGAC | ATGAG | GAGTGAGCC | X | | |
| 4 2 2 | AGCAGGGTT | TCTGCA | GTGTGAGGT | X | | |
| 4 2 2 | AGCAGCATG | GTTAG | GAGTGAGAT | X | | |
| 4 2 2 | ATCAGAGTC | AAAGG | GAGGGAGGC | X | | |
| 4 2 2 | AGCAGGGTT | GGAAGA | AAGTGAGGG | X | | |
| 4 2 2 | AGCAGGGTG | GGCAA | GAGGGAGGC | X | | |
| 4 2 2 | GGCAGTGTC | TCAAAC | GAGGGAGGG | X | | |
| 4 2 2 | GGCATCGTC | ACTCTT | GAGTGAGAG | X | | |
| 4 2 2 | AGCACCGTG | ACTTC | GAGGGAGGT | X | | |
| 4 2 2 | AGCAGAGTT | TAAAA | TAGTGAGGG | X | | |
| 4 3 1 | GACAGCCTC | ATTAT | GAGTGAGGC | X | | |
| 4 3 1 | AGGGGGTC | TTGGGA | GAGTGAGGT | X | | |
| 4 3 1 | AGCCTGGTC | CGTGA | GTGTGAGGA | X | | |
| 4 3 1 | GGCAGCGAT | GAGATT | GAGTGAGGG | X | | |
| 4 3 1 | AACAAGGTC | ATAAA | GAGGGAGGA | X | | |
| 4 3 1 | AGCTGAGAC | TTAGA | GAGTGAGGT | X | | |
| 4 3 1 | AGCTGAGAC | TTAGA | GAGTGAGGT | X | | |
| 4 3 1 | GGCAGAGTG | GAGGAA | GAGTGAGGC | X | | |
| 4 3 1 | AGCTGGGTT | GGAGTG | GAGTGAGGG | X | | |
| 4 3 1 | AGCAAAGGC | TAAAGA | GTGTGAGGA | X | | |
| 4 3 1 | AGTAACGGC | GGGGCT | GAGGGAGGA | X | | |
| 4 3 1 | AGCATTGTT | CTCAG | AAGTGAGGA | X | | |
| 4 3 1 | CACAGCATC | AGCAG | GAGTGAGGG | X | | |
| 4 3 1 | AGCCACATC | AGTCT | GAGTAAGGA | X | | |
| 4 3 1 | AGCAGCACA | CAGGCC | GAGTGAGGT | X | | |
| 4 3 1 | AGCATTGCC | TTTTG | GAGTGAGGG | X | | |
| 4 3 1 | AGAAGTGCC | ATCTGG | GAGTGAGGG | X | | |
| 4 3 1 | ATCAGCATA | CAGGG | GAGTGAGGC | X | | |
| 4 3 1 | AGCAGGTAC | GTGCCT | GAGTGAGGC | X | | |
| 4 3 1 | AACTACGTC | CACCA | GAGTGGGGA | X | | |
| 4 3 1 | AGAAGTGCC | ATCTAG | GAGTGAGGG | X | | |
| 4 3 1 | AGGAGTCTC | ATACT | GAGTGAGGT | X | | |
| 4 3 1 | TCCAGCGGC | CACAG | GAGTGAGGT | X | | |
| 4 3 1 | AGCTCAGTC | TCCCA | GGGTGAGGA | X | | |

| # of mutations T (−) (+) (−) | site | spacer | (+) site | VF2468 concentration 4 nM | 2 nM | 10.5 nM |
|---|---|---|---|---|---|---|
| 4 3 1 | AGCTCAGTC | TCTCA | GGGTGAGGA | X | | |
| 4 3 1 | AACAGTATC | TATTCT | GAGTGAGGC | X | | |
| 4 3 1 | GGAAGTGTC | TTACTG | GAGTGAGGT | X | | |
| 4 3 1 | CTCAGAGTC | AAACA | GAGTGAGGT | X | | |
| 4 3 1 | AACAGTGTT | TTGGCC | GAGTGAGGG | X | | |
| 4 3 1 | CTCAGCTTC | CTGTG | GAGTGAGGC | X | | |
| 4 3 1 | AGCAGCTGT | AGGGA | GAGTGAGGT | X | | |
| 4 3 1 | AGCTGTGTG | ATCCT | GAGTGAGGG | X | | |
| 4 3 1 | AGGTGTGTC | TTTGGA | GAGTGAGGC | X | | |
| 4 3 1 | ATTAGAGTC | TGGGTT | GGGTGAGGA | X | | |
| 4 3 1 | AGCCGGCTC | GCGAGT | GAGTGAGGG | X | | |
| 4 3 1 | AGCACCAGC | CCGGGT | GAGTGAGGT | X | | |
| 4 3 1 | TTCAGCGTT | GTGAA | GAGTGAGGC | X | | |
| 4 3 1 | AGCTCCTTC | GAGGA | GAGTGAGGC | X | | |
| 4 3 1 | AAGAGTGTC | CTGGTT | GAGTGAGGC | X | | |
| 4 3 1 | TGCAGGGTA | GTTGG | GAGTGAGGT | X | | |
| 4 3 1 | AGGATCATC | CAGAGT | GAGTGAGGC | X | | |
| 4 3 1 | GTCTGCGTC | CGAAGG | GAGTGAGGG | X | | |
| 4 3 1 | ATGAGCGAC | TGATG | GAGTGAGGG | X | | |
| 4 3 1 | CCCAGGGTC | CACAGA | GAGTGAGGG | X | | |
| 4 3 1 | AGTACAGTC | CATTTG | GAGGGAGGA | X | | |
| 4 3 1 | AGCTTCCTC | CATCTT | GAGTGAGGG | X | | |
| 4 3 1 | AGAAGTGCC | TCCTG | GAGTGAGGG | X | | |
| 4 3 1 | GGCAGAGTG | GATCA | GAGTGAGGC | X | | |
| 4 3 1 | AGCAGTTCC | TAAAA | GAGTGAGGG | X | | |
| 4 3 1 | GGCACTGTC | GCTCA | GAGTGAGGT | X | | |
| 4 3 1 | AGCAGGCAC | AGCCTG | GAGTGAGGC | X | | |
| 4 3 1 | AGTGGAGTC | CCCTA | GAGTGAGAA | X | | |
| 4 3 1 | AGGACAGTC | GCAGA | GAGTGAGGC | X | | |
| 4 3 1 | AGCTGTGTG | CTGCCA | GAGTGAGGC | X | | |
| 4 3 1 | AGCAAGGTG | GGTGGC | GTGTGAGGA | X | | |
| 4 3 1 | TGCTGTGTC | CCCAGT | GAGTGAGGG | X | | |
| 4 3 1 | GGCACAGTC | TGACA | GAGAGAGGA | X | | |
| 4 3 1 | AGCTCAGTC | TCACA | GGGTGAGGA | X | | |
| 4 3 1 | GTCAGTGTC | ATGCTT | GAGTGAGGC | X | | |
| 4 3 1 | GGAAGGGTC | CCAGTG | GAGTGAGGT | X | | |
| 4 3 1 | AGGAGCAAC | AAAGA | GAGTGAGGG | X | | |
| 4 3 1 | AGCGGTTTC | AGTGA | GAGTGAGGC | X | | |
| 4 3 1 | AGCAGCACG | GGGTG | AAGTGAGGA | X | | |
| 4 3 1 | AGAAGGGTG | GAGAAG | GAGTGAGGT | X | | |
| 4 3 1 | TGCTGTGTC | CATCCA | GAGTGAGGG | X | | |
| 4 3 1 | AGCTCAGTC | AACTG | GGGTGAGGA | X | | |
| 4 3 1 | AGCAAGGTT | AGGTTC | TAGTGAGGA | X | | |
| 4 3 1 | AGCTCAGTC | TCTCA | GGGTGAGGA | X | | |
| 4 3 1 | AGCACGGTG | GTCAA | GAGTGAGGC | X | | |
| 4 3 1 | AGCAGGGAT | TTGCA | GAGTGAGGC | X | | |
| 4 3 1 | ATCAGCTTT | GGGGTT | GAGTGAGGT | X | | |
| 4 3 1 | AGCACAGAC | AGCAT | GAGTGAGGC | X | | |
| 4 3 1 | CCCAGCTTC | TCAGG | GAGTGAGGC | X | | |
| 4 3 1 | CGCCCGTC | TGGGA | AAGTGAGGA | X | | |
| 4 3 1 | AGCAGAGGT | TCCCA | GAGTGAGGC | X | | |
| 4 3 1 | AGCCACCTC | CCCTGC | GAGTAAGGA | X | | |
| 4 3 1 | AGCCCTGTC | TGTTAA | GAGTGAGGT | X | | |
| 4 3 1 | AGCAGCAGT | CTCTG | GAGTGAGGT | X | | |
| 4 3 1 | AGCCACTTC | TAGGGA | GAGTGAGTA | X | | |
| 4 3 1 | AGGTGCGGC | AGGTA | GAGTGAGGG | X | | |
| 4 3 1 | AGCTGTGTG | GTTGG | GAGTGAGGG | X | | |
| 4 3 1 | AGGCGCTTC | ATTTAT | GAGTGAGGT | X | | |
| 4 3 1 | AGGAGTCTC | ACGATA | GAGTGAGGT | X | | |
| 4 3 1 | ATCATCCTC | CGCACT | GAGTGAGGG | X | | |
| 4 3 1 | AGCCGGGTA | GGGGAT | GAGTGAGGC | X | | |
| 4 3 1 | AGCAACTGC | TTTGTG | GAGTGAGGT | X | | |
| 4 3 1 | GGCAGCATT | TGAAGG | GAGTGAGGG | X | | |
| 4 3 1 | CACAGCATC | TGAGGT | GAGTGAGGG | X | | |
| 4 3 1 | AGCTGAGAC | TTAGA | GAGTGAGGT | X | | |
| 4 3 1 | ACCCGTGTC | ACAGTT | GAGTGAGGG | X | | |
| 4 3 1 | AGCCCTGTC | TGCTGG | GAGTGAGGG | X | | |
| 4 3 1 | GGACGCGTC | AGGCT | GAGTGAGGT | X | | |
| 4 3 1 | AGGAACCTC | GTGCG | GAGTGAGGC | X | | |
| 4 3 1 | AGCTGTGTG | GCCTT | GAGTGAGGC | X | | |
| 4 3 1 | CGCTGCGAC | CTTCA | GAGTGAGGC | X | | |

| # of mutations | | | | | | VF2468 concentration | | |
|---|---|---|---|---|---|---|---|---|
| T (−) | (+) | (−) site | spacer | (+) site | | 4 nM | 2 nM | 10.5 nM |
| 4 3 | 1 | GGTAGAGTC | AGACA | GAGTGAGGG | | X | | |
| 4 3 | 1 | AGCTGAGAC | TTAGA | GAGTGAGGT | | X | | |
| 4 3 | 1 | ACCAACCTC | CTGTCA | GAGTGAGGC | | X | | |
| 4 3 | 1 | AGCAGTCTG | CTGCAG | GAGTGAGGG | | X | | |
| 4 3 | 1 | TGCTGTGTC | CTCACA | TAGTGAGGA | | X | | |
| 4 3 | 1 | AGAAACTTC | AAGAAG | GAGTGAGGT | | X | | |
| 4 3 | 1 | AACAATGTC | GTCACA | GAGTGAGTA | | X | | |
| 4 3 | 1 | AGAAGGGTG | AATAAG | GAGTGAGGT | | X | | |
| 4 3 | 1 | TGCAGCGGA | GGCAG | GAGTGAGGG | | X | | |
| 4 3 | 1 | AGCTGTGTG | ACCTC | GAGTGAGGC | | X | | |
| 4 3 | 1 | AATAGAGTC | CTGGG | GAGTGAGGC | | X | | |
| 4 3 | 1 | AGCTGAGAC | TTAGA | GAGTGAGGT | | X | | |
| 4 3 | 1 | AGCTGAGAC | TTAGA | GAGTGAGGT | | X | | |
| 4 3 | 1 | AGTAGCATT | TTTAGT | GAGTGAGGG | | X | | |
| 4 3 | 1 | ACCGGAGTC | ATCCCT | GAGTGAGGG | | X | | |
| 4 3 | 1 | AGCAGTCTG | AAGGG | GAGTGAGGG | | X | | |
| 4 3 | 1 | AGCAGCACA | CAGGCC | GAGTGAGGT | | X | | |
| 4 3 | 1 | AGCAGCCAT | CAGAG | GAGTGAGGC | | X | | |
| 4 3 | 1 | GCCAGGGTC | CAAATG | GAGTGAGGC | | X | | |
| 4 3 | 1 | AGCATCTTA | GTGAT | GAGTGAGGT | | X | | |
| 4 3 | 1 | AGGAGCAAC | AGAGA | GAGTGAGGG | | X | | |
| 4 3 | 1 | AGCAGGTTT | ATTAGG | GAGTGAGGG | | X | | |
| 4 3 | 1 | GACAGCCTC | TCCCA | GAGTGAGGC | | X | | |
| 4 3 | 1 | AGCAGCAAT | GGCAG | GAGTGAGGT | | X | | |
| 4 3 | 1 | GGCAGCGGT | AGAGA | TAGTGAGGA | | X | | |
| 4 3 | 1 | AGTGGAGTC | CTGGA | GAGTGAGTA | | X | | |
| 4 3 | 1 | AGCCTGGTC | TGGCC | GTGTGAGGA | | X | | |
| 4 3 | 1 | AGAACCGAC | CAGCCA | GAGTGAGGG | | X | | |
| 4 3 | 1 | AGCAACATG | ACCCA | GAGTGAGGG | | X | | |
| 4 3 | 1 | AGCTCAGTC | TTGCA | GGGTGAGGA | | X | | |
| 4 3 | 1 | AGCTCAGTC | TCACA | GGGTGAGGA | | X | | |
| 4 3 | 1 | TGCAATGTC | AAGCTT | GAGTGAGAA | | X | | |
| 4 3 | 1 | GGCCCCGTC | ACGGT | GAGTGAGGG | | X | | |
| 4 3 | 1 | AGCTCAGTC | TCACA | GGGTGAGGA | | X | | |
| 4 3 | 1 | AGCAATGTA | GGGAGG | GAGTGAGGG | | X | | |
| 4 3 | 1 | AGTAACATC | CTGTTT | GTGTGAGGA | | X | | |
| 4 3 | 1 | ATCATTGTC | TCCACT | GAGTGAGAA | | X | | |
| 4 3 | 1 | AGTAGAGTT | TAGGG | GAGTGAGGG | | X | | |
| 4 3 | 1 | AGCAGGGGT | CAGCTG | GAGTGAGGG | | X | | |
| 4 3 | 1 | TGCTGTGTC | TTCCTG | GAGTGAGGC | | X | | |
| 4 3 | 1 | ATTAGAGTC | AGAGCA | GGGTGAGGA | | X | | |
| 4 3 | 1 | AGAAGGGTG | AGCAA | GAGTGAGGT | | X | | |
| 4 3 | 1 | CTCAGTGTC | TCTGTG | AAGTGAGGA | | X | | |
| 4 3 | 1 | AGCTGTGTT | CTGGAT | GAGTGAGGT | | X | | |
| 4 3 | 1 | AGTACAGTC | TAGCCA | GAGGGAGGA | | X | | |
| 4 3 | 1 | AGCCGCTTT | ATTCAA | GAGTGAGGG | | X | | |
| 4 3 | 1 | ACCGGTGTC | GTCGT | GAGTGAGGG | | X | | |
| 4 3 | 1 | AGCAGTGCT | GAGGC | GAGTGAGGC | | X | | |
| 4 3 | 1 | AGCTCAGTC | TCACA | GGGTGAGGA | | X | | |
| 4 3 | 1 | ATCTGCATC | TCTCTT | GAGTGAGGT | | X | | |
| 4 3 | 1 | AGCACAATC | CCCCAA | GAGTGAGGG | | X | | |
| 4 3 | 1 | AGCTCAGTC | TCACA | GGGTGAGGA | | X | | |
| 4 3 | 1 | ATCATCATC | TTGGA | GAGTGAGGC | | X | | |
| 4 3 | 1 | GGTAGAGTC | ACTGTA | GAGTGAGGG | | X | | |
| 4 3 | 1 | AGCTGTGTG | CTGGGG | GAGTGAGGC | | X | | |
| 4 3 | 1 | ATGAGTGTC | AGGTG | GAGTGAGGG | | X | | |
| 4 3 | 1 | GGCAGAGTG | GTCCAG | GAGTGAGGC | | X | | |
| 4 3 | 1 | AGGAGTCTC | CAGGGG | GAGTGAGGC | | X | | |
| 4 3 | 1 | AGCCAAGTC | CTGAG | GGGTGAGGA | | X | | |
| 4 3 | 1 | CGCTGAGTC | CAGAG | GAGTGAGGC | | X | | |
| 4 3 | 1 | GGCTCCGTC | TTATGT | GAGTGAGGC | | X | | |
| 4 3 | 1 | AGCAGCAGT | GAGGA | GAGTGAGGC | | X | | |
| 4 3 | 1 | AGTACTGTC | AACTA | CAGTGAGGA | | X | | |
| 4 3 | 1 | ATGAGCGGC | CGGTAG | GAGTGAGGT | | X | | |
| 4 3 | 1 | TGCAAGGTC | AGGAT | AAGTGAGGA | | X | | |
| 4 3 | 1 | AGTACAGTC | ACTGT | TAGTGAGGA | | X | | |
| 4 3 | 1 | ATCATTGTC | AGGTT | GAGTGAGAA | | X | | |
| 4 3 | 1 | CTCAGCGGC | TGCTGT | GAGTGAGGG | | X | | |
| 4 3 | 1 | AGCAGTCCC | ATCCAA | GAGTGAGGG | | X | | |
| 4 3 | 1 | AGCACAGGC | TGGACA | GAGTGAGGT | | X | | |
| 4 3 | 1 | AGCAACCAC | CTCCTG | GAGGGAGGA | | X | | |

-continued

| # of mutations T (−) (+) (−) | site | spacer | (+) site | VF2468 concentration 4 nM | 2 nM | 10.5 nM |
|---|---|---|---|---|---|---|
| 4 3 1 | AGTAAGGTC | AAGGA | GAGGGAGGA | X | | |
| 4 3 1 | CGCCCCGTC | TGGAG | AAGTGAGGA | X | | |
| 4 3 1 | TGCACAGTC | ACATG | GTGTGAGGA | X | | |
| 4 3 1 | AGCAGCAAG | TGGCA | GAGTGAGGC | X | | |
| 4 3 1 | AGCTCAGTC | TCACA | GGGTGAGGA | X | | |
| 4 3 1 | GGCAGGGTT | TCTCA | GAGTGAGGT | X | | |
| 4 3 1 | AGGATGGTC | CTTCC | AAGTGAGGA | X | | |
| 4 3 1 | AGCAACCCC | ATTTT | GAGTGAGGG | X | | |
| 4 3 1 | AGAAGCCAC | ATCAGT | GAGTGAGGG | X | | |
| 4 3 1 | ACCAATGTC | ACCTGT | GTGTGAGGA | X | | |
| 4 3 1 | AGGTGCGTG | GAGTG | GAGTGAGGG | X | | |
| 4 3 1 | AGCAGTGAA | GGGAA | GAGTGAGGC | X | | |
| 4 3 1 | AGCTGAGTG | ACAGCT | GAGTGAGGG | X | | |
| 4 3 1 | AGCAGTGCG | TGCAT | GAGTGAGGG | X | | |
| 4 3 1 | GGCGGGGTC | TGCTC | GAGTGAGGC | X | | |
| 4 3 1 | AGAATAGTC | TTAGA | CAGTGAGGA | X | | |
| 4 3 1 | AGCAGGGAT | TTGCA | GAGTGAGGC | X | | |
| 4 3 1 | GGAAGTGTC | CAAGG | GAGTGAGGT | X | | |
| 4 3 1 | ATCAATGTC | CTCTGT | GAGTGAGGG | X | | |
| 4 3 1 | CCCAGCTTC | CTGGG | GAGTGAGGC | X | | |
| 4 3 1 | AGGTGCGGC | AGGTA | GAGTGAGGG | X | | |
| 4 3 1 | AGCTGAGAC | TTAGA | GAGTGAGGT | X | | |
| 4 3 1 | AGCAACATG | GCTCA | GAGTGAGGG | X | | |
| 4 3 1 | TGCGCCGTC | TACTAG | GAGTGAGGC | X | | |
| 4 3 1 | AGCAAAGTT | TAACAA | GAGTGAGAA | X | | |
| 4 3 1 | AGCAAAGTT | TAACAA | GAGTGAGAA | X | | |
| 4 3 1 | AGCAAAGTT | TAACAA | GAGTGAGAA | X | | |
| 4 3 1 | AGCAAAGTT | TAACAA | GAGTGAGAA | X | | |
| 4 3 1 | AGCAAAGTT | TAACAA | GAGTGAGAA | X | | |
| 4 3 1 | AGTATCATC | CGGCT | GAGTGAGGT | X | | |
| 4 3 1 | AGCTGAGAC | TTAGA | GAGTGAGGT | X | | |
| 4 3 1 | AGGAGCAAC | CACAGG | GAGTGAGGG | X | | |
| 4 3 1 | AGCAGCTCG | CTGAG | GAGTGAGGG | X | | |
| 4 3 1 | AGCTGAGAC | TTAGA | GAGTGAGGT | X | | |
| 4 3 1 | AGCAATGTG | AGTTGT | GAGTGAGGG | X | | |
| 4 3 1 | AGAAGCGGT | GCGTCT | GAGTGAGGT | X | | |
| 4 3 1 | AGAAGTGCC | ATCTGT | GAGTGAGGG | X | | |
| 4 4 0 | GGATGAGTC | TGGAG | GAGTGAGGA | X | | |
| 4 4 0 | ACAGGTGTC | CAAGAT | GAGTGAGGA | X | | |
| 4 4 0 | CTGGGCGTC | CCTCCA | GAGTGAGGA | X | | |
| 4 4 0 | CCCGGGGTC | TTCAGT | GAGTGAGGA | X | | |
| 4 4 0 | TGGCACGTC | TGAGG | GAGTGAGGA | X | | |
| 4 4 0 | AGCTCAGTA | CAAAAA | GAGTGAGGA | X | | |
| 4 4 0 | AAAAGGTTC | AGAGG | GAGTGAGGA | X | | |
| 4 4 0 | GACATCATC | AGAACT | GAGTGAGGA | X | | |
| 4 4 0 | AGCACTATT | CTATTA | GAGTGAGGA | X | | |
| 4 4 0 | CCCTGAGTC | TGAGG | GAGTGAGGA | X | | |
| 4 4 0 | TGGGGAGTC | AGTGC | GAGTGAGGA | X | | |
| 4 4 0 | AACAGGGCT | TCTGA | GAGTGAGGA | X | | |
| 4 4 0 | AGCAAAGCT | CGAGA | GAGTGAGGA | X | | |
| 4 4 0 | AACATTGTT | TCAGT | GAGTGAGGA | X | | |
| 4 4 0 | AGACACTTC | ATGAAT | GAGTGAGGA | X | | |
| 4 4 0 | GCCCACGTC | TTCGTG | GAGTGAGGA | X | | |
| 4 4 0 | AACATGGTT | GTGTGG | GAGTGAGGA | X | | |
| 4 4 0 | GGTACAGTC | TTCGCC | GAGTGAGGA | X | | |
| 4 4 0 | GGCATGGTG | AGAGTG | GAGTGAGGA | X | | |
| 4 4 0 | GGAAGTCTC | AGGAT | GAGTGAGGA | X | | |
| 4 4 0 | ATCTTGGTC | AGGGCA | GAGTGAGGA | X | | |
| 4 4 0 | ATCAGGTCC | CAATT | GAGTGAGGA | X | | |
| 4 4 0 | GGCATGGTG | TAAAGA | GAGTGAGGA | X | | |
| 4 4 0 | TGAAACGTT | GCAGG | GAGTGAGGA | X | | |
| 4 4 0 | TGAATCGGC | AACAA | GAGTGAGGA | X | | |
| 4 4 0 | ATACACGTC | TCCTG | GAGTGAGGA | X | | |
| 4 4 0 | GGGAAGGTC | CTTGG | GAGTGAGGA | X | | |
| 4 4 0 | CACTGTGTC | GGGTGA | GAGTGAGGA | X | | |
| 4 4 0 | ATCTTTGTC | TTCCT | GAGTGAGGA | X | | |
| 4 4 0 | CTGAGGGTC | ATTGG | GAGTGAGGA | X | | |
| 4 4 0 | ATGTGAGTC | TTCTT | GAGTGAGGA | X | | |
| 4 4 0 | AAAGTCGTC | AGCTAT | GAGTGAGGA | X | | |
| 4 4 0 | AACAATGTT | CGCCT | GAGTGAGGA | X | | |
| 4 4 0 | GGGAAGGTC | CTATGG | GAGTGAGGA | X | | |

-continued

| # of mutations T | (+) | (−) | (−) site | spacer | (+) site | VF2468 concentration 4 nM | 2 nM | 10.5 nM |
|---|---|---|---|---|---|---|---|---|
| 4 | 4 | 0 | GGATGTGTC | TTCAGG | GAGTGAGGA | X | | |
| 4 | 4 | 0 | TCCACAGTC | TGGGT | GAGTGAGGA | X | | |
| 4 | 4 | 0 | AGCAAAGCT | ATATGG | GAGTGAGGA | X | | |
| 4 | 4 | 0 | CCCTGGGTC | CCAGGG | GAGTGAGGA | X | | |
| 4 | 4 | 0 | GTGAGGGTC | TCTGGA | GAGTGAGGA | X | | |
| 4 | 4 | 0 | AGCCAGGTT | GAAAAG | GAGTGAGGA | X | | |
| 4 | 4 | 0 | AGCATGGCT | TATGG | GAGTGAGGA | X | | |
| 4 | 4 | 0 | AGCTCAGGC | AGGGG | GAGTGAGGA | X | | |
| 4 | 4 | 0 | CCCTGGGTC | TGCTG | GAGTGAGGA | X | | |
| 4 | 4 | 0 | AGCAACAGA | TGAAG | GAGTGAGGA | X | | |
| 4 | 4 | 0 | AGCATGGCT | GGAATG | GAGTGAGGA | X | | |
| 4 | 4 | 0 | AGCTAAGTT | CTTGTA | GAGTGAGGA | X | | |
| 4 | 4 | 0 | AACTTTGTC | CTGAA | GAGTGAGGA | X | | |
| 4 | 4 | 0 | AACATGGTT | CCTTCT | GAGTGAGGA | X | | |
| 4 | 4 | 0 | CGCCACGGC | TGGGAG | GAGTGAGGA | X | | |
| 4 | 4 | 0 | CTCATTGTC | CAGGA | GAGTGAGGA | X | | |
| 4 | 4 | 0 | CCCTGGGTC | ATGTGA | GAGTGAGGA | X | | |
| 5 | 1 | 4 | AGCAACGTC | AAAGAT | CACTGATCA | X | | |
| 5 | 1 | 4 | AGCAGCGGC | GACAGC | AGAGGAGGA | X | | |
| 5 | 1 | 4 | AGCAGCGGC | AAGTGG | GAGTAGGAT | X | | |
| 5 | 1 | 4 | AGCAGCGGC | GGCACC | ACGTGCGCA | X | | |
| 5 | 1 | 4 | AGCACCGTC | AATCAG | GTGCGAGTC | X | | |
| 5 | 1 | 4 | AGCACCGTC | AAGAGT | CAGTGTTTA | X | | |
| 5 | 2 | 3 | AGCACAGTC | ACCTCT | GAGTGACAC | X | | |
| 5 | 2 | 3 | AGCAACGTA | TCGAT | GAGGGTAGA | X | | |
| 5 | 2 | 3 | AGCATCGGC | AGGCA | GAGTAAGTC | X | | |
| 5 | 2 | 3 | AACAACGTC | CTGAAC | GTGAGAGAA | X | | |
| 5 | 2 | 3 | AGCATAGTC | CGTGTA | GTGAGAGAA | X | | |
| 5 | 2 | 3 | AGCATGGTC | TTAATG | GAGTGATAG | X | | |
| 5 | 2 | 3 | AGCTGTGTC | TGCCTT | GGGTGATGC | X | | |
| 5 | 2 | 3 | AGCAATGTC | ATGTC | CAGTGAGCC | X | | |
| 5 | 2 | 3 | AGCATTGTC | CAAGGA | GAGTAAGTG | X | | |
| 5 | 2 | 3 | AGCAGCTGC | TCTCAA | GAGTATGGG | X | | |
| 5 | 2 | 3 | TGCAGTGTC | TGGAGT | GTGTCAGGC | X | | |
| 5 | 2 | 3 | AGCATTGTC | CTCCTC | TGGTGAGGT | X | | |
| 5 | 2 | 3 | AGCATTGTC | CCAAAA | GTGAGGGA | X | | |
| 5 | 2 | 3 | AGCAATGTC | TACCA | CAGTGAGAC | X | | |
| 5 | 2 | 3 | AGCAACGTT | CTTTAT | GTAAGAGGA | X | | |
| 5 | 2 | 3 | AGCAACTTC | ACTTAG | GCGTGGGAA | X | | |
| 5 | 3 | 2 | AGGCGAGTC | TCTTTA | GTGTGAGGC | X | | |
| 5 | 3 | 2 | AGCCACGTT | AGGGGT | AAGTGAGGG | X | | |
| 5 | 3 | 2 | AGTATCGTG | ATTGA | AAGTGAGGC | X | | |
| 5 | 3 | 2 | AGCAAGGTA | GCTTG | GAGTGAGAC | X | | |
| 5 | 3 | 2 | TGCAGCTGC | AAAAG | AAGTGAGGG | X | | |
| 5 | 3 | 2 | AGTATCTTC | TGGTGT | GAGTGAGAT | X | | |
| 5 | 3 | 2 | TGCAGTTTC | TCAAAG | GAGAGTGGA | X | | |
| 5 | 3 | 2 | ATCAGGGGC | CCACTA | GAGTAAGGG | X | | |
| 5 | 3 | 2 | AGTTGCTTC | TGCATT | GAGTAACGA | X | | |
| 5 | 3 | 2 | AGCTACGTG | CCCGGC | CAGTGAGGG | X | | |
| 5 | 3 | 2 | AGCTTAGTC | TGAGT | GTGTGAGGT | X | | |
| 5 | 3 | 2 | ATCAGGGGC | TGAAG | GAGTAAGGG | X | | |
| 5 | 3 | 2 | ATCAGGGGC | TGAAG | GAGTAAGGG | X | | |
| 5 | 3 | 2 | AGCAACCCC | TCTGCT | GAGGGAGGC | X | | |
| 5 | 3 | 2 | AGCATGGTA | TGATGT | AAGTGAGGG | X | | |
| 5 | 3 | 2 | CATAGCGTC | AGATTG | GAGTAAGGT | X | | |
| 5 | 3 | 2 | TGCAGCTGC | TGTCAG | AAGTGAGGG | X | | |
| 5 | 3 | 2 | AGCTAGGTC | CCCTG | CAGTGAGGG | X | | |
| 5 | 3 | 2 | AGCTTGGTC | AGTGAA | GAGAGAGGT | X | | |
| 5 | 3 | 2 | AGCAACTAC | ATATCT | GTGTGAGGC | X | | |
| 5 | 3 | 2 | AGCAACCCC | TCTGCT | GAGGGAGGC | X | | |
| 5 | 3 | 2 | GTCAGTGTC | CTGGAA | AAGTGAGGG | X | | |
| 5 | 3 | 2 | TGCAGTGTA | GCTGGA | GAGGGAGGT | X | | |
| 5 | 3 | 2 | CTCATCGTC | CAGGCT | GAGTGAGTC | X | | |
| 5 | 3 | 2 | AGTAACATC | AAGTCA | TAGTGAGGC | X | | |
| 5 | 3 | 2 | AGCTATGTC | CTAAAG | AAGTGAGGG | X | | |
| 5 | 3 | 2 | GTCCGCGTC | TTGTTT | GAGTAAGGG | X | | |
| 5 | 3 | 2 | AGCCTTGTC | ACTGA | AAGTGAGGC | X | | |
| 5 | 3 | 2 | AGCACAGCC | ACATCT | GTGTGAGGC | X | | |
| 5 | 3 | 2 | AGCAACATT | CTAAGC | GAGTGAGTC | X | | |
| 5 | 4 | 1 | AGTGTGGTC | GGAGCA | GAGTGAGGG | X | | |
| 5 | 4 | 1 | ACTAATGTC | ATGCTA | GAGTGAGGT | X | | |

-continued

| # of mutations T | (-) | (+) | (-) site | spacer | (+) site | VF2468 concentration 4 nM | 2 nM | 10.5 nM |
|---|---|---|---|---|---|---|---|---|
| 5 | 4 | 1 | TACATTGTC | TAGGAG | GAGTGAGGG | X | | |
| 5 | 4 | 1 | ATCAATGGC | CAGAT | GAGTGAGGG | X | | |
| 5 | 4 | 1 | CGGGGAGTC | CCAGGG | GAGTGAGGG | X | | |
| 5 | 4 | 1 | AGCAGGTCA | CATCG | GAGTGAGGG | X | | |
| 5 | 4 | 1 | AGCTAGGTT | GGCCC | GAGTGAGGC | X | | |
| 5 | 4 | 1 | AGTGTGGTC | AGAGAG | AAGTGAGGA | X | | |
| 5 | 4 | 1 | AGTATGGTA | ACAGCA | GAGTGAGGG | X | | |
| 5 | 4 | 1 | ATCCGTCTC | TTCTG | GTGTGAGGA | X | | |
| 5 | 4 | 1 | AACAGTATT | GCAAT | GAGTGAGGG | X | | |
| 5 | 4 | 1 | ATCAGCAGT | GAACA | AAGTGAGGA | X | | |
| 5 | 4 | 1 | GGCCAAGTC | AGCGG | GAGTGAGGC | X | | |
| 5 | 4 | 1 | GCCAGTGTT | TCTCA | GAGTGAGGT | X | | |
| 5 | 4 | 1 | ATCAGGGCA | GGCCAG | GAGTGAGGG | X | | |
| 5 | 4 | 1 | AGTAGATGC | AGTTA | GAGTGAGGT | X | | |
| 5 | 4 | 1 | GGCCTGGTC | AGGAGG | GAGTGAGGG | X | | |
| 5 | 4 | 1 | AGCAACTCA | TTCTGT | GAGTGAGGG | X | | |
| 5 | 4 | 1 | GGGGGAGTC | TTGCGG | GAGTGAGGT | X | | |
| 5 | 4 | 1 | ATCAGTCTA | GCAGCA | GAGTGAGGG | X | | |
| 5 | 4 | 1 | AGTAGATGC | ATAGG | GAGTGAGGT | X | | |
| 5 | 4 | 1 | ACCAGTGGT | GGGGT | GAGTGAGGT | X | | |
| 5 | 4 | 1 | GGCCTTGTC | CCCTA | GAGTGAGGG | X | | |
| 5 | 4 | 1 | CTCATTGTC | TTGCTG | GAGTGAGGC | X | | |
| 5 | 4 | 1 | AGTATGGTA | AAAGGA | GAGTGAGGG | X | | |
| 5 | 4 | 1 | AGAGAGGTC | AGGGTA | GAGTGAGGG | X | | |
| 5 | 4 | 1 | GGCCTGGTC | AGATTT | GAGTGAGGG | X | | |
| 5 | 4 | 1 | TGTTGAGTC | CGTATG | GAGTGAGGG | X | | |
| 5 | 4 | 1 | AGCACCACT | GACAG | GAGTGAGGG | X | | |
| 5 | 4 | 1 | AAAACAGTC | ATCCT | GAGTGAGGG | X | | |
| 5 | 4 | 1 | AACAGTATT | AAGGA | GAGTGAGGG | X | | |
| 5 | 4 | 1 | GCCAACATC | CACAT | GAGTGAGGT | X | | |
| 5 | 4 | 1 | GGCCAAGTC | TCTCA | GAGTGAGGC | X | | |
| 5 | 4 | 1 | AAAACAGTC | TTTCGA | GAGTGAGGG | X | | |
| 5 | 4 | 1 | AATCCCGTC | ATGGA | GAGTGAGGT | X | | |
| 6 | 4 | 2 | GGTTACGTC | CGGAA | AAGTGAGGG | X | | |
| 6 | 4 | 2 | AGTTACTTC | TATAA | AAGTGAGGG | X | | |
| 6 | 4 | 2 | AGTTACTTC | CCTCA | AAGTGAGGG | X | | |
| 3 | 2 | 1 | GGCATCGTC | CACTC | CAGTGAGGA | | X | X |
| 4 | 2 | 2 | ATCAGGGTC | CAGCT | CAGTGAGGC | | X | X |
| 4 | 3 | 1 | AGCTCAGTC | ACTCCT | GAGTGAGGG | | X | X |
| 4 | 3 | 1 | AGCTCAGTC | CTGGG | GAGTGAGGG | | X | X |
| 4 | 3 | 1 | AGCATGGTT | TTCTG | GAGTGAGGC | | X | X |
| 4 | 3 | 1 | AGATGGGTC | TTGCT | GAGTGAGGC | | X | | X |
| 4 | 3 | 1 | AGATGGGTC | TTGCT | GAGTGAGGC | | X | | X |
| 2 | 1 | 1 | AGCAGAGTC | AGGAT | GAATGAGGA | | X | |
| 2 | 1 | 1 | AGCAGAGTC | ATGAA | GATTGAGGA | | X | |
| 3 | 0 | 3 | AGCAGCGTC | TGAAAG | TAGAGATGA | | X | |
| 3 | 0 | 3 | AGCAGCGTC | AGCTTC | AAGTATGGA | | X | |
| 3 | 0 | 3 | AGCAGCGTC | AACATT | TAGTAATGA | | X | |
| 3 | 0 | 3 | AGCAGCGTC | AACATT | TAGTAATGA | | X | |
| 3 | 1 | 2 | AGCAGTGTC | TTAGGA | AAGAGAGGA | | X | |
| 3 | 1 | 2 | AGCAGCTTC | AGATGG | GAGAGAGAA | | X | |
| 3 | 1 | 2 | AGCAGTGTC | CAGCA | AAGAGAGGA | | X | |
| 3 | 1 | 2 | TGCAGCGTC | AATGT | GAGTGAAAA | | X | |
| 3 | 1 | 2 | AGCAGTGTC | AGGTAT | GAGAGGGA | | X | |
| 3 | 1 | 2 | AGCAGCTTC | AGGGA | GAGTGTGGG | | X | |
| 3 | 1 | 2 | AGCAGTGTC | CTTGCC | GAAGGAGGA | | X | |
| 3 | 1 | 2 | AGCAGCTTC | ATGAAG | GAGAGAGAA | | X | |
| 3 | 1 | 2 | AGCAGCGTG | GAGGT | GAGTGGGGT | | X | |
| 3 | 1 | 2 | AGCAGCGTT | ACTCAG | GAGAGAGAA | | X | |
| 3 | 1 | 2 | AGAAGCGTC | ACTGA | GAGTGAGTT | | X | |
| 3 | 1 | 2 | AGCAGCATC | TTGAG | GGGTGAGGC | | X | |
| 3 | 1 | 2 | AGCAGCGGC | ACAAA | GAGGGACGA | | X | |
| 3 | 1 | 2 | AGCATCGTC | TGAAG | GGGTGAGCA | | X | |
| 3 | 1 | 2 | AGCAGCTTC | CACCA | GAGGGAGTA | | X | |
| 3 | 1 | 2 | AGCAGCGTT | CTGTCT | AAGTGAAGA | | X | |
| 3 | 1 | 2 | AGCAGCATC | TGCTTC | GGGTGAGGC | | X | |
| 3 | 1 | 2 | AGCAGGGTC | GGGGA | GGGTGAGAA | | X | |
| 3 | 1 | 2 | AGCAGGGTC | AGCTGG | GAGTAAGAA | | X | |
| 3 | 1 | 2 | AGCAGCGCC | GGAAGA | GAGCGAGGG | | X | |
| 3 | 1 | 2 | AGCACCGTC | CCTAA | GACTGAGCA | | X | |
| 3 | 1 | 2 | AGCAGAGTC | ACAGCT | GAATGAGGC | | X | |

-continued

| # of mutations T | (+) | (-) | (-) site | spacer | (+) site | 4 nM | 2 nM | 10.5 nM |
|---|---|---|---|---|---|---|---|---|
| 3 | 1 | 2 | AGCAGCGTG | GACCCA | AAGAGAGGA | X | | |
| 3 | 1 | 2 | AGCAGGGTC | CACAT | GAGTCAGGG | X | | |
| 3 | 1 | 2 | AGCAGGGTC | GGGGTG | GAGGGAGAA | X | | |
| 3 | 1 | 2 | GGCAGCGTC | CAGGTA | GACTGAGGG | X | | |
| 3 | 1 | 2 | AGCAGTGTC | CTAAAG | GAAGGAGGA | X | | |
| 3 | 1 | 2 | AGCAGCCTC | TTCTG | TAATGAGGA | X | | |
| 3 | 1 | 2 | AGCAGCGTT | GGGAA | GAGAGAGAA | X | | |
| 3 | 1 | 2 | AGCAGCGAC | AGGGCA | GAATGAGGC | X | | |
| 3 | 1 | 2 | AGCAGAGTC | GAGCA | AGGTGAGGA | X | | |
| 3 | 1 | 2 | AGCAGCATC | GAGTGG | AAGTGGGGA | X | | |
| 3 | 2 | 1 | AGCTGAGTC | CAGAA | GAGTGGGGA | X | | |
| 3 | 2 | 1 | GGCAGTGTC | AGTAG | GTGTGAGGA | X | | |
| 3 | 2 | 1 | AGCAACTTC | AGAAT | GAGTTAGGA | X | | |
| 3 | 2 | 1 | AGCATCTTC | AGCTA | TAGTGAGGA | X | | |
| 3 | 2 | 1 | GGCAGGGTC | ACCCGA | AAGTGAGGA | X | | |
| 3 | 2 | 1 | AGCAGTGTG | TGCCCA | GAGTGAGTA | X | | |
| 3 | 2 | 1 | AGCAGTGTA | CCATGC | GAGTGAGCA | X | | |
| 3 | 2 | 1 | AGCTGGGTC | TATTTG | GAGTCAGGA | X | | |
| 3 | 2 | 1 | AGCAGCGAG | GTGGG | GAGTGAGTA | X | | |
| 3 | 2 | 1 | AGCAGCTTG | GATTCA | GAGTGAGAA | X | | |
| 3 | 2 | 1 | AGCAGCAGC | AACGAG | GAGCGAGGA | X | | |
| 3 | 2 | 1 | AGCACCATC | TTTGAA | AAGTGAGGA | X | | |
| 3 | 2 | 1 | AGCAGAGTT | TGAATT | GAGTTAGGA | X | | |
| 3 | 2 | 1 | GGCAGGGTC | AAGGA | AAGTGAGGA | X | | |
| 3 | 2 | 1 | GGCAGTGTC | CAGGAG | GTGTGAGGA | X | | |
| 3 | 2 | 1 | TGCAACGTC | ACAAGT | GAGAGAGGA | X | | |
| 3 | 2 | 1 | AACAGTGTC | TTTCAA | AAGTGAGGA | X | | |
| 3 | 2 | 1 | AGCAGTGTA | GACCCA | GAGTGAGCA | X | | |
| 3 | 2 | 1 | AGCTGTGTC | CCCTT | GAGAGAGGA | X | | |
| 3 | 2 | 1 | AGCAGCGGA | GGTGGG | GAGGGAGGA | X | | |
| 3 | 2 | 1 | AACAGCTTC | TCATT | GAGTGAGTA | X | | |
| 3 | 2 | 1 | AGTAGAGTC | AGGCCT | GAATGAGGA | X | | |
| 3 | 2 | 1 | AGCAGCGAA | GCCGG | AAGTGAGGA | X | | |
| 3 | 2 | 1 | AACTGCGTC | CCAGG | AAGTGAGGA | X | | |
| 3 | 2 | 1 | AGAAGCCTC | TGCTAT | GAGTGAGGC | X | | |
| 3 | 2 | 1 | AGCAGTGTG | CAATG | GAGTGAGTA | X | | |
| 3 | 2 | 1 | AGTAGAGTC | CCTGG | GAGTGAGCA | X | | |
| 3 | 2 | 1 | GGCAGTGTC | ATGTGT | GAGGGAGGA | X | | |
| 3 | 2 | 1 | AGCACTGTC | ACTGTT | GAGTGATGA | X | | |
| 3 | 2 | 1 | AGCTGGGTC | TGGGAG | GAGTCAGGA | X | | |
| 3 | 2 | 1 | AGCAGCTTT | CCAAGA | GAGTGAGAA | X | | |
| 3 | 2 | 1 | AGCAGTGTA | GACCCA | GAGTGAGCA | X | | |
| 3 | 2 | 1 | GGCAGCGTG | GGGATG | CAGTGAGGA | X | | |
| 3 | 2 | 1 | AGCAGCAGC | AGAGG | GAGCGAGGA | X | | |
| 3 | 2 | 1 | AGTAGCTTC | CCTCT | GTGTGAGGA | X | | |
| 3 | 2 | 1 | TGCGGCGTC | TCCTGG | GAGTGAAGA | X | | |
| 3 | 2 | 1 | AACAGAGTC | TGGCA | GAGTGAGCA | X | | |
| 3 | 2 | 1 | GGCAGCGGC | CTGGG | GAGTGTGGA | X | | |
| 3 | 2 | 1 | AGCAGGCTC | CTTGT | TAGTGAGGA | X | | |
| 3 | 3 | 0 | ATCACCATC | ATACCT | GAGTGAGGA | X | | |
| 3 | 3 | 0 | AGCAGTTTA | ATTCT | GAGTGAGGA | X | | |
| 3 | 3 | 0 | AACAGCAAC | AAAAA | GAGTGAGGA | X | | |
| 3 | 3 | 0 | AGCTGAGTA | GAATG | GAGTGAGGA | X | | |
| 3 | 3 | 0 | AGCAACCTG | GGGCT | GAGTGAGGA | X | | |
| 3 | 3 | 0 | AGCAACCTG | GAAAA | GAGTGAGGA | X | | |
| 3 | 3 | 0 | TGCAGGCTC | CTGTG | GAGTGAGGA | X | | |
| 3 | 3 | 0 | CGCAGTATC | CCACT | GAGTGAGGA | X | | |
| 3 | 3 | 0 | AGAAACATC | AGATG | GAGTGAGGA | X | | |
| 3 | 3 | 0 | ACCTGTGTC | TCCTG | GAGTGAGGA | X | | |
| 3 | 3 | 0 | GGCAGGGCC | TCAAGG | GAGTGAGGA | X | | |
| 3 | 3 | 0 | AGAAACATC | TAAGAG | GAGTGAGGA | X | | |
| 3 | 3 | 0 | AGGTGCATC | CCTCA | GAGTGAGGA | X | | |
| 3 | 3 | 0 | GGCAGGGCC | TTCTT | GAGTGAGGA | X | | |
| 3 | 3 | 0 | GGCAGCTGC | TTTTT | GAGTGAGGA | X | | |
| 3 | 3 | 0 | AGCATGGCC | CAGGAG | GAGTGAGGA | X | | |
| 4 | 0 | 4 | AGCAGCGTC | TTCAGC | AAGTGGAGG | X | | |
| 4 | 0 | 4 | AGCAGCGTC | TGGGGC | AGTGGAGGA | X | | |
| 4 | 0 | 4 | AGCAGCGTC | TCATA | GAGTTAACC | X | | |
| 4 | 0 | 4 | AGCAGCGTC | CCTGA | AATTGTGCA | X | | |
| 4 | 1 | 3 | AGCAACGTC | AGGGAA | GAGGGACCA | X | | |
| 4 | 1 | 3 | AGCAGGGTC | CACTCA | GAGGGAGTC | X | | |

| # of mutations | | | | | | VF2468 concentration | | |
|---|---|---|---|---|---|---|---|---|
| T (−) | (+) | (−) site | spacer | (+) site | 4 nM | 2 nM | 10.5 nM | |
| 4 | 1 | 3 | AGCAGCGTG | TGGCT | GTGTGTGGC | X | | |
| 4 | 1 | 3 | AGCAGCGTT | GGCTGA | AAGTGAGGT | X | | |
| 4 | 1 | 3 | AGCAACGTC | TCCAGG | GACTGAAGC | X | | |
| 4 | 1 | 3 | AGCAGGGTC | ATTTAG | GAGTGACAT | X | | |
| 4 | 1 | 3 | AGCAGTGTC | TTGTCA | GAGTGTGTC | X | | |
| 4 | 1 | 3 | AGCAACGTC | CTCAAG | GAGGCAAGA | X | | |
| 4 | 1 | 3 | AGCATCGTC | CACCTG | GCGAGAGGC | X | | |
| 4 | 1 | 3 | AGCAGCTTC | TAACA | AAGTGAGAC | X | | |
| 4 | 1 | 3 | AGCAACGTC | AGGGAG | GAGAGGGCA | X | | |
| 4 | 1 | 3 | AGCAGCGTT | TTCAT | GTGTGTGTA | X | | |
| 4 | 1 | 3 | AGCAGCGTT | TAACT | GAGTGAAAG | X | | |
| 4 | 1 | 3 | AGCAGGGTC | AGCAG | GAGGGAGTC | X | | |
| 4 | 1 | 3 | AGCAGTGTC | ATTAC | GAGTGCGAC | X | | |
| 4 | 1 | 3 | AGCAGTGTC | AGTGC | AAGTGCGGG | X | | |
| 4 | 1 | 3 | AGCAGCTTC | CATCG | TGGTGTGGA | X | | |
| 4 | 1 | 3 | GGCAGCGTC | TAGGG | GTGTGATAA | X | | |
| 4 | 1 | 3 | AGCAGCTTC | CGGTC | GAGTGATTT | X | | |
| 4 | 1 | 3 | AGCAGGGTC | CGGCTT | GTGTGCGGC | X | | |
| 4 | 1 | 3 | AGCAGCGGC | AAGAA | GAGGGTGGT | X | | |
| 4 | 1 | 3 | AGCAGCCTC | ACTCA | GAGTGGGAC | X | | |
| 4 | 1 | 3 | AGCAACGTC | TCCACA | GAGACAGGC | X | | |
| 4 | 1 | 3 | AGCAGCGTG | GGGGA | GTGTGGGGG | X | | |
| 4 | 1 | 3 | AGCAGGGTC | TGCAGG | GACTGAGAG | X | | |
| 4 | 1 | 3 | AGCAGTGTC | TTTTC | CAGTAAGGT | X | | |
| 4 | 1 | 3 | AGCAGCGGC | AAGCAC | AAGCAAGGA | X | | |
| 4 | 1 | 3 | AGCAGCTTC | CTCCAG | GGGAGAGGT | X | | |
| 4 | 1 | 3 | AGCAGCTTC | GCCTGC | TGGTGTGGA | X | | |
| 4 | 1 | 3 | AGCAGCGAC | TCACAC | AAGTGAGAT | X | | |
| 4 | 1 | 3 | AGCAGCGGC | CCCAGC | GAGTGTGTC | X | | |
| 4 | 1 | 3 | AGCAGTGTC | TGCAAC | TAGTGAGCT | X | | |
| 4 | 1 | 3 | AGCAGCGGC | CTGGGG | ACGAGAGGA | X | | |
| 4 | 1 | 3 | AGCAGCGGC | TGCCA | GAGGGTGGT | X | | |
| 4 | 1 | 3 | AGCAACGTC | CATTCT | GAGGCAAGA | X | | |
| 4 | 2 | 2 | AGCATTGTC | GGATTC | TGGTGAGGA | X | | |
| 4 | 2 | 2 | AGCATGGTC | ACAAA | GGGTGAGGT | X | | |
| 4 | 2 | 2 | AGCAACATC | ACAGA | GAGAGAGGG | X | | |
| 4 | 2 | 2 | AGCAATGTC | CCTTG | GAGTGTGGG | X | | |
| 4 | 2 | 2 | AGCAGCTGC | CAGAG | GAGGGAGGC | X | | |
| 4 | 2 | 2 | AGCTGGGTC | CTAGA | AAGTGAGGT | X | | |
| 4 | 2 | 2 | AGCAGCTGC | AGTGA | GAGTGAGCT | X | | |
| 4 | 2 | 2 | AGCATTGTC | AATGA | CAGTGAGAA | X | | |
| 4 | 2 | 2 | AGCAAAGTC | TAAGA | GAGTGTGGC | X | | |
| 4 | 2 | 2 | AGCAGGGTG | GAGAA | GAGCGAGGG | X | | |
| 4 | 2 | 2 | ATCAACGTC | CTTTGA | GAGAAAGGA | X | | |
| 4 | 2 | 2 | AGCAGCTTT | TTTCC | GAGTGAGAG | X | | |
| 4 | 2 | 2 | GGCAGCGTT | TCCTGT | GAGCAAGGA | X | | |
| 4 | 2 | 2 | AGCACCATC | AGGAG | GAGGGAGGG | X | | |
| 4 | 2 | 2 | ATCAGAGTC | TGCAG | GCGTGAGGC | X | | |
| 4 | 2 | 2 | AGCACCGGC | CTCTTG | GAGGGAGGT | X | | |
| 4 | 2 | 2 | GGCAGGGTC | AGTGG | GAGTGAGTC | X | | |
| 4 | 2 | 2 | AGCACCTTC | TCCTGG | TAGTGAGGC | X | | |
| 4 | 2 | 2 | AGCGGTGTC | ATCCAG | GAGTGAGCG | X | | |
| 4 | 2 | 2 | AGCAATGTC | TATAA | AAGTGAGGC | X | | |
| 4 | 2 | 2 | AGCAGGGTA | AGTAC | AAGTGAGGC | X | | |
| 4 | 2 | 2 | AGCAACGTG | ATCGG | GAGGGAGGG | X | | |
| 4 | 2 | 2 | AGCAGGGTA | GATGG | GAGAGAGGG | X | | |
| 4 | 2 | 2 | AGCAATGTC | TGGGT | GAGTGTGGG | X | | |
| 4 | 2 | 2 | AGCAATGTC | TGAAA | TAGTGAGTA | X | | |
| 4 | 2 | 2 | TGCAGAGTC | AAGGAA | GAGTGAGAT | X | | |
| 4 | 2 | 2 | AGCATAGTC | TCCTAG | GAGAGAGGC | X | | |
| 4 | 2 | 2 | AGCAGGGTA | ATGGG | GAGAGAGGG | X | | |
| 4 | 2 | 2 | ATCACCGTC | GAGGG | GAGGGAGGG | X | | |
| 4 | 2 | 2 | GGCAGCTTC | GGTGTC | CAGTGAGGC | X | | |
| 4 | 2 | 2 | AGCTGGGTC | TCATTG | CAGTGAGGT | X | | |
| 4 | 2 | 2 | AGCAACGTA | CTGTT | AAGTGAGAA | X | | |
| 4 | 2 | 2 | AGCAAAGTC | AAGAA | GAGTGAAAA | X | | |
| 4 | 2 | 2 | GGCAGGGTC | TCTCA | AAGTGAGGT | X | | |
| 4 | 2 | 2 | TGCAGGGTC | ATGCAA | GTGTGAGGT | X | | |
| 4 | 2 | 2 | AGCAAAGTC | AGAGCT | GAGTGAGCC | X | | |
| 4 | 2 | 2 | GGCAGTGTC | ATTTTT | GAGTAAGGG | X | | |
| 4 | 2 | 2 | AGCAGCTGC | TGTGG | GAGGGAGGC | X | | |

| # of mutations T | (−) | (+) | (−) site | spacer | (+) site | VF2468 concentration 4 nM | 2 nM | 10.5 nM |
|---|---|---|---|---|---|---|---|---|
| 4 | 2 | 2 | AGCAGCGGT | GGTATC | TAGTGAGGC | | X | |
| 4 | 2 | 2 | AGCAACATC | TGGAAC | GAGTGAATA | | X | |
| 4 | 2 | 2 | AGCAGTGTG | ATCTT | GAGTAAGGC | | X | |
| 4 | 2 | 2 | GGCAGCTTC | AGCAC | CAGTGAGGC | | X | |
| 4 | 2 | 2 | AGCAGAGTT | GCTTAA | GAGTGAGAG | | X | |
| 4 | 2 | 2 | AGCACCTTC | TGCCAA | GAGTGAGAT | | X | |
| 4 | 2 | 2 | AGCAGCTGC | GGGCA | GAGTGAGCT | | X | |
| 4 | 2 | 2 | AGTAGAGTC | TTTGTT | GTGTGAGGT | | X | |
| 4 | 2 | 2 | AGCATGGTC | GTTGGG | GGGTGAGGC | | X | |
| 4 | 2 | 2 | AGCATTGTC | TCTTGT | GTGTGAGGT | | X | |
| 4 | 2 | 2 | ATCAGAGTC | AATTTG | TAGTGAGGT | | X | |
| 4 | 2 | 2 | AGCAGCTTA | GAGGG | GAGAGAGGT | | X | |
| 4 | 2 | 2 | GACAGCGTC | CTCCG | GGGTGAGGC | | X | |
| 4 | 2 | 2 | TGCAGAGTC | AGCCCT | GAGTGAGAT | | X | |
| 4 | 2 | 2 | AGCAGAGTT | GGAAG | GAGTGAGAG | | X | |
| 4 | 2 | 2 | AGCAGGGTA | GGTCA | GAGAGAGGG | | X | |
| 4 | 3 | 1 | TGCAGTGAC | TGTCCA | GAGTGAGGC | | X | |
| 4 | 3 | 1 | AGCAGAGGT | GAGGT | GAGTGAGGG | | X | |
| 4 | 3 | 1 | AGCAGTTTA | AATTT | GAGTGAGGC | | X | |
| 4 | 3 | 1 | AGAAAGGTC | ATAAT | GAGTGAGGG | | X | |
| 4 | 3 | 1 | AGCACAATC | CCAAAG | GAGTGAGGC | | X | |
| 4 | 3 | 1 | AGCAAAGGC | AGGAG | GAGTGAGGT | | X | |
| 4 | 3 | 1 | AGCCACATC | CCCTA | GAGTGAGGT | | X | |
| 4 | 3 | 1 | TGCTGGGTC | TACAG | GAGTGAGGC | | X | |
| 4 | 3 | 1 | GGCAGTGTG | AGCTG | GAGTGAGGG | | X | |
| 4 | 3 | 1 | AGTAGTGTG | CTGAA | GAGTGAGGG | | X | |
| 4 | 3 | 1 | TGCATGGTC | AGAGGT | GAGTGAGGG | | X | |
| 4 | 3 | 1 | AGCATAGTT | TAGGAT | CAGTGAGGA | | X | |
| 4 | 3 | 1 | AGCAGCAGG | ATGAGA | GAGTGAGGC | | X | |
| 4 | 3 | 1 | AGCACCATT | AAATTG | GAGTGAGGC | | X | |
| 4 | 3 | 1 | ATCAGGGTT | AAGCA | GAGTGAGGC | | X | |
| 4 | 3 | 1 | AGCAAAGTG | GAGAG | GAGGGAGGA | | X | |
| 4 | 3 | 1 | AGCAACACC | AATGAA | GAGTGAAGA | | X | |
| 4 | 3 | 1 | GGCAGTGGC | TCTGT | GAGTGAGGT | | X | |
| 4 | 3 | 1 | AGTATCGGC | TGTGGT | GAGTGAGGG | | X | |
| 4 | 3 | 1 | GGCAGCTCC | GCCTCC | GAGTGAGGG | | X | |
| 4 | 3 | 1 | AGCAAAGGC | TGGGTG | GAGTGAGGT | | X | |
| 4 | 3 | 1 | AGCAAGTTC | CACTG | GAGTGTGGA | | X | |
| 4 | 3 | 1 | AGCAAAGGC | AGTCA | GAGTGAGGG | | X | |
| 4 | 3 | 1 | CGCAGCAAC | GCTCTG | GAGTGAGGC | | X | |
| 4 | 3 | 1 | GGCAGCGGT | TGGGG | GAGTGAGGC | | X | |
| 4 | 3 | 1 | AGCAACTGC | TTTTA | GAGTGAGCA | | X | |
| 4 | 3 | 1 | AGAAGAGTA | AAGCA | GAGTGAGGT | | X | |
| 4 | 3 | 1 | AGCAACATA | ATAACA | GAGTGAGGT | | X | |
| 4 | 3 | 1 | CGCACCTTC | CTGTAT | GAGTGAGGC | | X | |
| 4 | 3 | 1 | GTCCGCGTC | GCCCA | GAGTGAGAA | | X | |
| 4 | 3 | 1 | GGCAGTGTG | CTTGAT | GAGTGAGGG | | X | |
| 4 | 3 | 1 | CCCACCGTC | CTAAAG | AAGTGAGGA | | X | |
| 4 | 3 | 1 | AACAACGTG | AAACCA | GAGTGAGGC | | X | |
| 4 | 3 | 1 | AGCAACCAC | AAAAA | AAGTGAGGA | | X | |
| 4 | 3 | 1 | AGCCCCTTC | AGCATA | GAGTGAGGG | | X | |
| 4 | 3 | 1 | AGCCGCTGC | AGCAGG | GAGTGAGGT | | X | |
| 4 | 3 | 1 | AGCCGCTGC | AGCAGG | GAGTGAGGT | | X | |
| 4 | 3 | 1 | AGCCGCTGC | AGCAGG | GAGTGAGGT | | X | |
| 4 | 3 | 1 | AGCCGCTGC | AGCAGG | GAGTGAGGT | | X | |
| 4 | 3 | 1 | AGAGGGTC | TGCAG | GAGTGAGGG | | X | |
| 4 | 3 | 1 | AGCAAAGGC | AAATA | GAGTGAGGG | | X | |
| 4 | 3 | 1 | GGCAACTTC | CAAGA | AAGTGAGGA | | X | |
| 4 | 3 | 1 | GCCAGCTTC | CATACA | GAGTGAGGC | | X | |
| 4 | 3 | 1 | AGAAGGGTG | ATTAG | GAGTGAGGC | | X | |
| 4 | 3 | 1 | AGCTACGAC | TCAGGA | GAGTGAGGT | | X | |
| 4 | 3 | 1 | AGCAAGGTG | GGCGG | GAGTGAGGG | | X | |
| 4 | 3 | 1 | AGGAGAGTT | AGAAGA | GAGTGAGGT | | X | |
| 4 | 3 | 1 | TGCTCCGTC | CTGGCT | GAGTGAGGT | | X | |
| 4 | 3 | 1 | AGCACTGTT | TGCCC | GAGTGAGGC | | X | |
| 4 | 3 | 1 | AGTACCATC | AGGGCT | GAGTGAGGC | | X | |
| 4 | 3 | 1 | AGCAGCAGG | GCAGT | GAGTGAGGC | | X | |
| 4 | 3 | 1 | GGCAGGGAC | CATAT | GAGTGAGGC | | X | |
| 4 | 3 | 1 | AGCAAGGTT | CCCCG | GAGTGAGTA | | X | |
| 4 | 3 | 1 | AGCATGGGC | AGGGG | GAGTGAGGC | | X | |
| 4 | 3 | 1 | AGCTGAGTA | GCTAA | GAGTGAGGC | | X | |

| # of mutations T (−) (+) (−) | site | spacer | (+) site | VF2468 concentration 4 nM | 2 nM | 10.5 nM |
|---|---|---|---|---|---|---|
| 4 3 1 | AGCGACTTC | ATATCT | GAGTGAGGT | X | | |
| 4 3 1 | AGGAGAGTT | TAAAG | GAGTGAGGT | X | | |
| 4 3 1 | GACAGCATC | AGTCTG | GAGTGAGGG | X | | |
| 4 3 1 | AGCAACTCC | ATTTC | GAGTGAGGC | X | | |
| 4 3 1 | AGTCGCTTC | ACTTTG | GAGTGAGAA | X | | |
| 4 3 1 | AGTAACATC | TTTACT | GAGGGAGGA | X | | |
| 4 3 1 | AGCAACTGC | AATGGT | GAGTGAGCA | X | | |
| 4 3 1 | AGCATTGTG | CTAGG | CAGTGAGGA | X | | |
| 4 3 1 | AGAAAAGTC | TTGAAG | GAGTGAGGG | X | | |
| 4 3 1 | GGCAGTGTA | GGGAG | GAGTGAGGT | X | | |
| 4 3 1 | AGCAAGGTA | AAGGAG | GAGTGAGGT | X | | |
| 4 3 1 | AGCATCTGC | AGATG | GAGTGAGGC | X | | |
| 4 3 1 | TGCATAGTC | TTGGG | GAGTGAGGG | X | | |
| 4 3 1 | AGAAGGGTG | AGGTGG | GAGTGAGGC | X | | |
| 4 3 1 | AGCCGAGTG | GTTAA | GAGTGAGGG | X | | |
| 4 3 1 | CTCAGGGTC | ATTAGT | GAGTGAGGG | X | | |
| 4 3 1 | AACAGGGTT | GGCCT | GAGTGAGGC | X | | |
| 4 3 1 | AGCCTAGTC | ACACCT | GAGTGAGGG | X | | |
| 4 3 1 | AGCAATGTT | TTGCT | GAGTGAGAA | X | | |
| 4 3 1 | AGCAGCAAA | TCTGCT | GAGTGAGGT | X | | |
| 4 3 1 | AGCAGTCCC | TGCCCA | GAGTGAGGC | X | | |
| 4 3 1 | TGCAATGTC | TTTGA | GAGTGAGGT | X | | |
| 4 3 1 | TGCAGGTTC | TTTGG | GAGTGAGGG | X | | |
| 4 3 1 | AGCTAAGTC | TGTAGG | CAGTGAGGA | X | | |
| 4 3 1 | AGCATAGTT | GGGAG | CAGTGAGGA | X | | |
| 4 3 1 | AGCATGGTA | GAGACT | GAGTGAGGG | X | | |
| 4 3 1 | AGCAAGGAC | TGGGCT | GAGTGAGGC | X | | |
| 4 3 1 | AGGTGGGTC | CCCAGA | GAGTGAGGC | X | | |
| 4 3 1 | AGCAGCTGT | CAATCA | GAGTGAGGC | X | | |
| 4 3 1 | TGCATGGTC | CTGGAG | GAGTGAGGG | X | | |
| 4 3 1 | AGCATAGTA | CTTAA | GAGTGAGGG | X | | |
| 4 3 1 | AGCAAGGTA | ATTAG | GAGTGAGTA | X | | |
| 4 3 1 | TGCACCTTC | ATGCCT | GAGTGAGGG | X | | |
| 4 3 1 | AGCACCGAG | GTCGGA | GAGTGAGGG | X | | |
| 4 3 1 | TGGAGAGTC | AGCAG | GAGTGAGTA | X | | |
| 4 3 1 | AGAAGAGTT | AGGTGG | GAGTGAGGT | X | | |
| 4 3 1 | ATCAGGGTT | AGGAT | GAGTGAGGG | X | | |
| 4 3 1 | GGCAGTGCC | CAGCAG | GAGTGAGGC | X | | |
| 4 3 1 | AGTAAGGTC | TTAAA | TAGTGAGGA | X | | |
| 4 3 1 | AGCAGCAGG | CCAGT | GAGTGAGGC | X | | |
| 4 4 0 | AGCCATGTG | CAAGT | GAGTGAGGA | X | | |
| 4 4 0 | GGTAGTGTT | ATGAAT | GAGTGAGGA | X | | |
| 4 4 0 | TACAAAGTC | GATGA | GAGTGAGGA | X | | |
| 4 4 0 | AGCCATGTA | CATGT | GAGTGAGGA | X | | |
| 4 4 0 | GACTGGGTC | TGTCAT | GAGTGAGGA | X | | |
| 4 4 0 | AGCACAGCA | GATGA | GAGTGAGGA | X | | |
| 4 4 0 | TGAATAGTC | TTGGAA | GAGTGAGGA | X | | |
| 4 4 0 | GTCAGGTTC | ACACAT | GAGTGAGGA | X | | |
| 4 4 0 | GGTAAAGTC | TGGTCA | GAGTGAGGA | X | | |
| 4 4 0 | AGTATAGTG | GCAGA | GAGTGAGGA | X | | |
| 4 4 0 | ATGGGGTC | AGAGGG | GAGTGAGGA | X | | |
| 4 4 0 | CCCAAAGTC | GTAAG | GAGTGAGGA | X | | |
| 4 4 0 | CAAATCGTC | TACAT | GAGTGAGGA | X | | |
| 4 4 0 | AATAAGGTC | ATAGCA | GAGTGAGGA | X | | |
| 4 4 0 | AGTATAGTT | CAGAT | GAGTGAGGA | X | | |
| 4 4 0 | AGAGAGGTC | AAGGA | GAGTGAGGA | X | | |
| 4 4 0 | TGGTGAGTC | ACCAC | GAGTGAGGA | X | | |
| 4 4 0 | TGCCTGGTC | ACTTGG | GAGTGAGGA | X | | |
| 4 4 0 | AGCCATGTG | GGAAG | GAGTGAGGA | X | | |
| 4 4 0 | AACAGGTT | CGCAGA | GAGTGAGGA | X | | |
| 4 4 0 | AGCAATTTA | TGTACA | GAGTGAGGA | X | | |
| 4 4 0 | AGGCATGTC | TCAGCA | GAGTGAGGA | X | | |
| 4 4 0 | TACAAAGTC | CTTAG | GAGTGAGGA | X | | |
| 4 4 0 | AATAAGGTC | AGAGAG | GAGTGAGGA | X | | |
| 4 4 0 | AATAAGTC | AGATAG | GAGTGAGGA | X | | |
| 4 4 0 | AATAAGGTC | AGATAG | GAGTGAGGA | X | | |
| 4 4 0 | AATAAGGTC | AAATAG | GAGTGAGGA | X | | |
| 4 4 0 | AATAAGGTC | AGATG | GAGTGAGGA | X | | |
| 4 4 0 | AATAAGGTC | AGATAG | GAGTGAGGA | X | | |
| 4 4 0 | AGCACAGCA | GGCAG | GAGTGAGGA | X | | |
| 4 4 0 | GGAAAGGTC | AGTTAT | GAGTGAGGA | X | | |

| # of mutations | | | | | | VF2468 concentration | | |
|---|---|---|---|---|---|---|---|---|
| T (−) | (+) | (−) | site | spacer | (+) site | 4 nM | 2 nM | 10.5 nM |
| 4 | 4 | 0 | AGCCATTTC | AACAA | GAGTGAGGA | X | | |
| 4 | 4 | 0 | AATAAGGTC | ACGGTG | GAGTGAGGA | X | | |
| 4 | 4 | 0 | ATCAGCACT | TCAGA | GAGTGAGGA | X | | |
| 4 | 4 | 0 | GGTGGGGTC | ATGGA | GAGTGAGGA | X | | |
| 4 | 4 | 0 | CACACAGTC | AGTGTA | GAGTGAGGA | X | | |
| 4 | 4 | 0 | AATATTGTC | TCTGT | GAGTGAGGA | X | | |
| 4 | 4 | 0 | GGAATAGTC | TGGTTA | GAGTGAGGA | X | | |
| 4 | 4 | 0 | AGCAACAAT | CGTAC | GAGTGAGGA | X | | |
| 4 | 4 | 0 | AATAAGGTC | ACAGTG | GAGTGAGGA | X | | |
| 4 | 4 | 0 | GACTGTGTC | CTTCA | GAGTGAGGA | X | | |
| 4 | 4 | 0 | AATAAAGTC | AGATAG | GAGTGAGGA | X | | |
| 4 | 4 | 0 | AATAAGGTC | AGAGAG | GAGTGAGGA | X | | |
| 4 | 4 | 0 | AATAAGGTC | AGACAA | GAGTGAGGA | X | | |
| 4 | 4 | 0 | AATAAGGTC | AGATAG | GAGTGAGGA | X | | |
| 4 | 4 | 0 | AATAAGGTC | AGATG | GAGTGAGGA | X | | |
| 5 | 1 | 4 | AGCAGCTTC | CCCTG | CAGAAAGGT | X | | |
| 5 | 2 | 3 | GGCAACGTC | ATCTC | TAGTGAGAC | X | | |
| 5 | 2 | 3 | AGCAGTTTC | TTTTAC | TTGTGAGGG | X | | |
| 5 | 2 | 3 | AGCAGTTTC | AGTATC | TTGTGAGGG | X | | |
| 5 | 2 | 3 | AGCAGCAGC | CGAAC | GAGGGAGAT | X | | |
| 5 | 2 | 3 | AGCAGCAGC | CCAGG | GAGGGAGAT | X | | |
| 5 | 2 | 3 | AGCAACTTC | TCTAA | TTGTGAGGT | X | | |
| 5 | 2 | 3 | AGCAACTTC | CACAG | TTGTGAGGT | X | | |
| 5 | 2 | 3 | AGCAAGGTC | AGTGA | TAGTGAATA | X | | |
| 5 | 2 | 3 | AGCAGTTTC | GGTGTT | TTGTGAGGG | X | | |
| 5 | 2 | 3 | AGCAGCAGC | AGGAA | GAGGGAGAT | X | | |
| 5 | 2 | 3 | AGCATTGTC | TTAGA | AAGTAAGGG | X | | |
| 5 | 3 | 2 | AGCCCAGTC | TCAGG | GAGTGAGAG | X | | |
| 5 | 3 | 2 | AGCTACATC | TGCATT | GAGTGAGTC | X | | |
| 5 | 3 | 2 | AGCATGGTT | TGAAAG | GAGTGAGCC | X | | |
| 5 | 3 | 2 | GACAGGGTC | CACTTG | GAGTGAGTC | X | | |
| 5 | 3 | 2 | ATCCTCGTC | CTGCA | GAGTGAGTC | X | | |
| 5 | 3 | 2 | CAGAGCGTC | CAGGT | GAGTGAGTC | X | | |
| 5 | 3 | 2 | AGCAAAGGC | CTGAAG | GAGTAAGGG | X | | |
| 5 | 3 | 2 | AGCATCGAT | TAAAA | GAGTGAGAG | X | | |
| 5 | 3 | 2 | ATCATGGTC | ACTTT | GAGGGAGGG | X | | |
| 5 | 3 | 2 | AGCCCAGTC | CCCCTA | GAGTGAGAG | X | | |
| 5 | 3 | 2 | TGCATAGTC | AATTT | GAGTGAGAT | X | | |
| 5 | 3 | 2 | AGCCATGTC | AGCTT | GAGGGAGGT | X | | |
| 5 | 3 | 2 | AGCATTGTA | GGGGAC | GAGTGTGGT | X | | |
| 5 | 3 | 2 | ATCATGGTC | CAGGA | GAGGGAGGG | X | | |
| 5 | 3 | 2 | AGCAAAGGC | CAAGT | GAGTAAGGG | X | | |
| 5 | 3 | 2 | ATAAGAGTC | ATGCAG | GAGTGAGTG | X | | |
| 5 | 3 | 2 | AGCCATGTC | CCAAGG | GAGGGAGGT | X | | |
| 5 | 3 | 2 | AGCAAAGGC | AATGA | GAGTAAGGG | X | | |
| 5 | 3 | 2 | AGCCCAGTC | AGGAT | GAGTGAGAG | X | | |
| 5 | 4 | 1 | TTCCACGTC | AACAT | GAGTGAGGG | X | | |
| 5 | 4 | 1 | AGTCAGGTC | CCCACA | GAGTGAGGT | X | | |
| 5 | 4 | 1 | CTGAGGGTC | GGTAG | GAGTGAGGC | X | | |
| 5 | 4 | 1 | ATGACAGTC | TATGCA | GAGTGAGGC | X | | |
| 5 | 4 | 1 | AACAGTCTA | CCTGA | GAGTGAGGC | X | | |
| 5 | 4 | 1 | CTCAGTTTC | CTGAG | GAGTGAGGG | X | | |
| 5 | 4 | 1 | AGTCAGGTC | TTCCAT | GAGTGAGGG | X | | |
| 5 | 4 | 1 | GTGGGCGTC | CACTAA | GAGTGAGGC | X | | |
| 5 | 4 | 1 | GGTGGGGTC | CTTGAA | GAGTGAGGC | X | | |
| 5 | 4 | 1 | AGTTAAGTC | TCTAGA | GAGTGAGGG | X | | |
| 5 | 4 | 1 | TTCACCTTC | CACCAT | GAGTGAGGC | X | | |
| 5 | 4 | 1 | TCCTGAGTC | TTGGTA | GAGTGAGGC | X | | |
| 5 | 4 | 1 | ATAATAGTC | TCCAT | GAGTGAGGC | X | | |
| 5 | 4 | 1 | AGCAAAGGT | GGGGTG | GAGTGAGGT | X | | |
| 5 | 4 | 1 | AGTTTAGTC | CTTGG | GAGTGAGGT | X | | |
| 5 | 4 | 1 | ACAAAGGTC | CTCCA | GAGTGAGGC | X | | |
| 5 | 4 | 1 | TGCAGTCCC | AATCA | GAGTGAGGT | X | | |
| 5 | 4 | 1 | AGTCATGTC | GTTAA | GAGTGAGGC | X | | |
| 5 | 4 | 1 | CACCACGTC | AAGGTA | GAGAGAGGA | X | | |
| 5 | 4 | 1 | CTCAGTTTC | AAAAGC | GAGTGAGGG | X | | |
| 5 | 4 | 1 | GAAAGTGTC | CAAGTG | GAGTGAGGC | X | | |
| 5 | 4 | 1 | GGGTGGGTC | TAGAGG | GAGTGAGGT | X | | |
| 5 | 4 | 1 | AGAGTTGTC | CCCCAA | GAGTGAGGC | X | | |
| 6 | 4 | 2 | AGAAGGGGT | AGGAG | GAGTGAGAG | X | | |
| 3 | 1 | 2 | AGCAGAGTC | ATATT | GAGTCAGGG | | | X |

| # of mutations | | | VF2468 concentration | | | | |
|---|---|---|---|---|---|---|---|
| T | (−) | (+) | (−) site | spacer | (+) site | 4 nM | 2 nM | 10.5 nM |
| 3 | 3 | 0 | ACCATCTTC | ATCAG | GAGTGAGGA | | | X |
| 4 | 2 | 2 | AGGAACGTC | TCCAA | GGGTGAGGG | | | X |
| 4 | 2 | 2 | AGCACCTTC | AGAGG | GAGTGTGGC | | | X |
| 4 | 2 | 2 | GGCAGGGTC | GGTCA | GAGTGAGAG | | | X |
| 4 | 2 | 2 | GGCAGGGTC | ACAGGT | GAGTGAGAG | | | X |
| 4 | 2 | 2 | AGCACAGTC | AAGCT | GAGGGAGGT | | | X |
| 4 | 2 | 2 | GGCAGGGTC | TAGGCA | GAGTGAGAG | | | X |
| 4 | 2 | 2 | AGCAAGGTC | TACTCG | GGGTGAGGC | | | X |
| 4 | 3 | 1 | AGCAAGTTC | CGTTAA | GAGTGAGGT | | | X |
| 4 | 3 | 1 | AGCAGTTTT | TGCAGT | GAGTGAGGC | | | X |
| 2 | 1 | 1 | AGCTGCGTC | ACATG | GACTGAGGA | X | | |
| 3 | 1 | 2 | AGCAGGGTC | TGAGCT | GTGTGGGGA | | | X |
| 3 | 1 | 2 | AGCAGGGTC | AGCTG | GTGTGGGGA | | | X |
| 3 | 2 | 1 | AGAAGCCTC | AAGGAT | GAGTGAGGT | X | | |
| 3 | 2 | 1 | AGAAGCCTC | ATAAGT | GAGTGAGGT | | | X |
| 3 | 3 | 0 | AGCATTTTC | AATTT | GAGTGAGGA | | | X |
| 4 | 0 | 4 | AGCAGCGTC | CCTCC | GACACTGGA | | | X |
| 4 | 1 | 3 | AGCAGTGTC | ACCGAC | AGGTGAGGC | | | X |
| 4 | 1 | 3 | AGCAGTGTC | TGGGA | GAGGGTAGA | | | X |
| 4 | 2 | 2 | AGCAACTTC | TTCCT | GGGTGAGGC | | | X |
| 4 | 3 | 1 | AGCCCGGTC | TGAAAG | GAGTGAAGA | | | X |
| 4 | 3 | 1 | AGTAACTTC | TGAGTG | GAGTGAGGC | | | X |
| 4 | 3 | 1 | AGTAACTTC | AAAAT | GAGTGAGGC | | | X |
| 4 | 3 | 1 | ACCTGCTTC | AAAGT | GAGTGAGGG | | | X |
| 4 | 3 | 1 | AGCATTTTC | CCCCTA | AAGTGAGGA | | | X |
| 4 | 3 | 1 | AGTAACTTC | AGTATA | GAGTGAGGC | | | X |
| 4 | 3 | 1 | AGCAATGTT | TGAGT | GAGTGATGA | | | X |
| 4 | 3 | 1 | AGCATTTTC | CTTTA | AAGTGAGGA | | | X |
| 4 | 3 | 1 | AGCCACGGC | TGCCTG | GAGTGAGGG | | | X |
| 4 | 4 | 0 | CCTAGAGTC | CAGGA | GAGTGAGGA | | | X |
| 5 | 4 | 1 | ATCATAGTG | ACCAC | GAGTGAGGC | | | X |

SEQUENCE LISTING (8776 sequences)

SEQ ID NO: 1 - DNA, 14 bp, Artificial Sequence
  Synthetic nucleic acid molecule
  misc_feature (1)..(1): n is a, c, g, or t
  misc_feature (14)..(14): n is a, c, g, or t
ngatgaggatgacn

SEQ ID NO: 2 - DNA, 14 bp, Artificial Sequence
  Synthetic nucleic acid molecule
  misc_feature (1)..(1): n is a, c, g, or t
  misc_feature (14)..(14): n is a, c, g, or t
naaactgcaaaagn

SEQ ID NO: 3 - DNA, 11 bp, Artificial Sequence
  Synthetic nucleic acid molecule
  misc_feature (1)..(1): n is a, c, g, or t
  misc_feature (11)..(11): n is a, c, g, or t
ngagtgaggan

SEQ ID NO: 4 - DNA, 11 bp, Artificial Sequence
  Synthetic nucleic acid molecule
  misc_feature (1)..(1): n is a, c, g, or t
  misc_feature (11)..(11): n is a, c, g, or t
ngacggtgctn

SEQ ID NO: 5 - DNA, 12 bp, Artificial Sequence
  Synthetic nucleic acid molecule
gtcatcctcatc

SEQ ID NO: 6 - DNA, 12 bp, Artificial Sequence
  Synthetic nucleic acid molecule
aaactgcaaaag

SEQ ID NO: 7 - DNA, 12 bp, Artificial Sequence
  Synthetic nucleic acid molecule
gatgaggatgac

SEQ ID NO: 8 - DNA, 12 bp, Artificial Sequence
  Synthetic nucleic acid molecule
gatgaggggcga

SEQ ID NO: 9 - DNA, 12 bp, Artificial Sequence
  Synthetic nucleic acid molecule
gatgaggcacga

SEQ ID NO: 10 - DNA, 12 bp, Artificial Sequence
  Synthetic nucleic acid molecule
gctgaggataac

SEQ ID NO: 11 - DNA, 12 bp, Artificial Sequence
  Synthetic nucleic acid molecule
gatacagatgac

SEQ ID NO: 12 - DNA, 12 bp, Artificial Sequence
  Synthetic nucleic acid molecule
aaactggaaaag

SEQ ID NO: 13 - DNA, 12 bp, Artificial Sequence
  Synthetic nucleic acid molecule
aaaatggaacag

SEQ ID NO: 14 - DNA, 12 bp, Artificial Sequence
  Synthetic nucleic acid molecule
aaactggaaaaa

SEQ ID NO: 15 - DNA, 9 bp, Artificial Sequence
  Synthetic nucleic acid molecule
gagtgagga

SEQ ID NO: 16 - DNA, 9 bp, Artificial Sequence
  Synthetic nucleic acid molecule
gagtgaaac

SEQ ID NO: 17 - DNA, 9 bp, Artificial Sequence
  Synthetic nucleic acid molecule
gagtgagtc

SEQ ID NO: 18 - DNA, 9 bp, Artificial Sequence
  Synthetic nucleic acid molecule
gtgtgaaaa

SEQ ID NO: 19 - DNA, 9 bp, Artificial Sequence
  Synthetic nucleic acid molecule
gagtgagga

SEQ ID NO: 20 - DNA, 9 bp, Artificial Sequence
  Synthetic nucleic acid molecule
gacgctgct

SEQ ID NO: 21 - DNA, 9 bp, Artificial Sequence
  Synthetic nucleic acid molecule
gacgttgct

SEQ ID NO: 22 - DNA, 9 bp, Artificial Sequence
  Synthetic nucleic acid molecule
gacgttact

SEQ ID NO: 23 - DNA, 9 bp, Artificial Sequence
  Synthetic nucleic acid molecule
gacgttgct

SEQ ID NO: 24 - DNA, 9 bp, Artificial Sequence
  Synthetic nucleic acid molecule
gacgaaacc

SEQ ID NO: 25 - DNA, 14 bp, Artificial Sequence
  Synthetic nucleic acid molecule
  misc_feature (1)..(1): n is a, c, g, or t
  misc_feature (14)..(14): n is a, c, g, or t
ngatgaggatgacn

SEQ ID NO: 26 - DNA, 14 bp, Artificial Sequence
  Synthetic nucleic acid molecule
  misc_feature (1)..(1): n is a, c, g, or t
  misc_feature (14)..(14): n is a, c, g, or t
naaactgcaaaagn

SEQ ID NO: 27 - DNA, 11 bp, Artificial Sequence
  Synthetic nucleic acid molecule
  misc_feature (1)..(1): n is a, c, g, or t
  misc_feature (11)..(11): n is a, c, g, or t
ngagtgaggan

SEQ ID NO: 28 - DNA, 11 bp, Artificial Sequence
  Synthetic nucleic acid molecule
  misc_feature (1)..(1): n is a, c, g, or t
  misc_feature (11)..(11): n is a, c, g, or t
ngacgctgctn

SEQ ID NO: 29 - DNA, 14 bp, Artificial Sequence
  Synthetic nucleic acid molecule
  misc_feature (1)..(1): n is a, c, g, or t
  misc_feature (14)..(14): n is a, c, g, or t
ngatgaggatgacn

SEQ ID NO: 30 - DNA, 14 bp, Artificial Sequence
  Synthetic nucleic acid molecule
  misc_feature (1)..(1): n is a, c, g, or t
  misc_feature (14)..(14): n is a, c, g, or t
naaactgcaaaagn

SEQ ID NO: 31 - DNA, 14 bp, Artificial Sequence
  Synthetic nucleic acid molecule
  misc_feature (1)..(1): n is a, c, g, or t
  misc_feature (14)..(14): n is a, c, g, or t
ngatgaggatgacn

SEQ ID NO: 32 - DNA, 12 bp, Artificial Sequence
  Synthetic nucleic acid molecule
gatgaggatgac

SEQ ID NO: 33 - DNA, 12 bp, Artificial Sequence
  Synthetic nucleic acid molecule
gatgaggatgac

SEQ ID NO: 34 - DNA, 14 bp, Artificial Sequence
  Synthetic nucleic acid molecule
  misc_feature (1)..(1): n is a, c, g, or t
  misc_feature (14)..(14): n is a, c, g, or t
naaactgcaaaagn

SEQ ID NO: 35 - DNA, 12 bp, Artificial Sequence
  Synthetic nucleic acid molecule
aaactgcaaaag

SEQ ID NO: 36 - DNA, 12 bp, Artificial Sequence
  Synthetic nucleic acid molecule
aaactgcaaaag

SEQ ID NO: 37 - DNA, 12 bp, Artificial Sequence
  Synthetic nucleic acid molecule
gatgaggatgac

SEQ ID NO: 38 - DNA, 12 bp, Artificial Sequence
  Synthetic nucleic acid molecule
gtcatcctcatc

SEQ ID NO: 39 - DNA, 12 bp, Artificial Sequence
  Synthetic nucleic acid molecule
aaactgcaaaag

SEQ ID NO: 40 - DNA, 11 bp, Artificial Sequence
  Synthetic nucleic acid molecule
  misc_feature (1)..(1): n is a, c, g, or t
  misc_feature (11)..(11): n is a, c, g, or t
ngagtgaggan

SEQ ID NO: 41 - DNA, 11 bp, Artificial Sequence
  Synthetic nucleic acid molecule
  misc_feature (1)..(1): n is a, c, g, or t
  misc_feature (11)..(11): n is a, c, g, or t
ngacgctgctn

SEQ ID NO: 42 - DNA, 18 bp, Artificial Sequence
  Synthetic nucleic acid molecule
ttcattacacctgcagct

SEQ ID NO: 43 - DNA, 43 bp, Artificial Sequence
  Synthetic nucleic acid molecule
ttcattacacctgcagctctcattttccatacagtcagtatca

SEQ ID NO: 44 - DNA, 43 bp, Artificial Sequence
  Synthetic nucleic acid molecule
tgatactgactgtatggaaaatgagagctgcaggtgtaatgaa

SEQ ID NO: 45 - DNA, 18 bp, Artificial Sequence
  Synthetic nucleic acid molecule
agaaggtcttaactatga

SEQ ID NO: 46 - protein, 34 aa, Artificial Sequence
  Synthetic polypeptide
LTPEQVVAIASNIGGKQALETVQRLLPVLCQAHG

SEQ ID NO: 47 - DNA, 19 bp, Artificial Sequence
  Synthetic nucleic acid molecule
tggagccatctggccgggt

SEQ ID NO: 48 - DNA, 19 bp, Artificial Sequence
  Synthetic nucleic acid molecule
  misc_feature (1)..(1): n is a, c, g, or t
nttcattacacctgcagct

SEQ ID NO: 49 - DNA, 19 bp, Artificial Sequence
  Synthetic nucleic acid molecule
  misc_feature (1)..(1): n is a, c, g, or t
ntcttccagaattgatact

SEQ ID NO: 50 - DNA, 19 bp, Artificial Sequence
  Synthetic nucleic acid molecule
  misc_feature (1)..(1): n is a, c, g, or t
nttcattacacctgcagct

SEQ ID NO: 51 - DNA, 19 bp, Artificial Sequence
  Synthetic nucleic acid molecule
  misc_feature (1)..(1): n is a, c, g, or t
ntcttccagaattgatact

SEQ ID NO: 52 - DNA, 18 bp, Artificial Sequence
  Synthetic nucleic acid molecule
ttcattacacctgcagct

SEQ ID NO: 53 - DNA, 18 bp, Artificial Sequence
  Synthetic nucleic acid molecule
tcttccagaattgatact

SEQ ID NO: 54 - DNA, 16 bp, Artificial Sequence
  Synthetic nucleic acid molecule
tcttcattacacctgc

SEQ ID NO: 55 - DNA, 13 bp, Artificial Sequence
  Synthetic nucleic acid molecule
tcattacacctgc

SEQ ID NO: 56 - DNA, 10 bp, Artificial Sequence
  Synthetic nucleic acid molecule
ttacacctgc

SEQ ID NO: 57 - DNA, 45 bp, Artificial Sequence
  Synthetic nucleic acid molecule
tcttcattacacctgcagctctcattttccatacagtcagtatca

SEQ ID NO: 58 - DNA, 45 bp, Artificial Sequence
  Synthetic nucleic acid molecule
tgatactgactgtatggaaaatgagagctgcaggtgtaatgaaga

SEQ ID NO: 59 - DNA, 16 bp, Artificial Sequence
  Synthetic nucleic acid molecule
tgatactgactgtatg

SEQ ID NO: 60 - DNA, 13 bp, Artificial Sequence
  Synthetic nucleic acid molecule
tactgactgtatg

SEQ ID NO: 61 - DNA, 10 bp, Artificial Sequence
  Synthetic nucleic acid molecule
tgactgtatg

SEQ ID NO: 62 - DNA, 16 bp, Artificial Sequence
  Synthetic nucleic acid molecule
tcttcattacacctgc

SEQ ID NO: 63 - DNA, 13 bp, Artificial Sequence
  Synthetic nucleic acid molecule
tcattacacctgc

SEQ ID NO: 64 - DNA, 10 bp, Artificial Sequence
  Synthetic nucleic acid molecule
ttacacctgc

SEQ ID NO: 65 - DNA, 45 bp, Artificial Sequence; identical to SEQ ID NO: 57
  Synthetic nucleic acid molecule

SEQ ID NO: 66 - DNA, 45 bp, Artificial Sequence; identical to SEQ ID NO: 58
  Synthetic nucleic acid molecule

SEQ ID NO: 67 - DNA, 16 bp, Artificial Sequence
  Synthetic nucleic acid molecule
tgatactgactgtatg

SEQ ID NO: 68 - DNA, 13 bp, Artificial Sequence
  Synthetic nucleic acid molecule
tactgactgtatg

SEQ ID NO: 69 - DNA, 10 bp, Artificial Sequence
  Synthetic nucleic acid molecule
tgactgtatg

SEQ ID NO: 70 - DNA, 10 bp, Artificial Sequence
  Synthetic nucleic acid molecule
tagttgaggc

SEQ ID NO: 71 - DNA, 10 bp, Artificial Sequence
  Synthetic nucleic acid molecule
caacacaatt

SEQ ID NO: 72 - DNA, 10 bp, Artificial Sequence
  Synthetic nucleic acid molecule
gtgcagaacc

SEQ ID NO: 73 - DNA, 10 bp, Artificial Sequence
  Synthetic nucleic acid molecule
cattatcaac

SEQ ID NO: 74 - DNA, 10 bp, Artificial Sequence
  Synthetic nucleic acid molecule
ttacgattaa

SEQ ID NO: 75 - DNA, 10 bp, Artificial Sequence
  Synthetic nucleic acid molecule
tccatagaaa

SEQ ID NO: 76 - DNA, 10 bp, Artificial Sequence
  Synthetic nucleic acid molecule
ggcgccttcc

SEQ ID NO: 77 - DNA, 10 bp, Artificial Sequence
  Synthetic nucleic acid molecule
atttatgtaa

SEQ ID NO: 78 - DNA, 10 bp, Artificial Sequence
  Synthetic nucleic acid molecule
aatatgggga

SEQ ID NO: 79 - DNA, 10 bp, Artificial Sequence
  Synthetic nucleic acid molecule
cgttagggac

SEQ ID NO: 80 - DNA, 16 bp, Artificial Sequence
  Synthetic nucleic acid molecule
atacagttaggtatca

SEQ ID NO: 81 - DNA, 16 bp, Artificial Sequence
  Synthetic nucleic acid molecule
atacagtcaagtattg

SEQ ID NO: 82 - DNA, 16 bp, Artificial Sequence
  Synthetic nucleic acid molecule
aacacacagtcattca

SEQ ID NO: 83 - DNA, 16 bp, Artificial Sequence
  Synthetic nucleic acid molecule
agcatacggtcagtca

SEQ ID NO: 84 - DNA, 16 bp, Artificial Sequence
  Synthetic nucleic acid molecule
cgcatacagtcattat

SEQ ID NO: 85 - DNA, 16 bp, Artificial Sequence
  Synthetic nucleic acid molecule
caatcagaatgtatca

SEQ ID NO: 86 - DNA, 16 bp, Artificial Sequence
  Synthetic nucleic acid molecule
gagttatacagtcaga

SEQ ID NO: 87 - DNA, 16 bp, Artificial Sequence
  Synthetic nucleic acid molecule
cgcagacacagtaact

SEQ ID NO: 88 - DNA, 16 bp, Artificial Sequence
  Synthetic nucleic acid molecule
gaccatacagtcataa

SEQ ID NO: 89 - DNA, 16 bp, Artificial Sequence
  Synthetic nucleic acid molecule
ggtatcatacagttag

SEQ ID NO: 90 - DNA, 10 bp, Artificial Sequence
  Synthetic nucleic acid molecule
catacagtca

SEQ ID NO: 91 - DNA, 10 bp, Artificial Sequence
  Synthetic nucleic acid molecule
cagttgcagt

SEQ ID NO: 92 - DNA, 10 bp, Artificial Sequence
  Synthetic nucleic acid molecule
ttattctcta

SEQ ID NO: 93 - DNA, 10 bp, Artificial Sequence
  Synthetic nucleic acid molecule
ttctcccagt

SEQ ID NO: 94 - DNA, 10 bp, Artificial Sequence
  Synthetic nucleic acid molecule
cctggaaaag

SEQ ID NO: 95 - DNA, 10 bp, Artificial Sequence
  Synthetic nucleic acid molecule
aggtgtttgc

SEQ ID NO: 96 - DNA, 10 bp, Artificial Sequence
  Synthetic nucleic acid molecule
catcaacaac

SEQ ID NO: 97 - DNA, 10 bp, Artificial Sequence
  Synthetic nucleic acid molecule
atgattatta

SEQ ID NO: 98 - DNA, 10 bp, Artificial Sequence
  Synthetic nucleic acid molecule
taacaaatcg

SEQ ID NO: 99 - DNA, 10 bp, Artificial Sequence
  Synthetic nucleic acid molecule
cctacttcta

SEQ ID NO: 100 - DNA, 10 bp, Artificial Sequence
  Synthetic nucleic acid molecule
tgtcgaacat

SEQ ID NO: 101 - DNA, 16 bp, Artificial Sequence
  Synthetic nucleic acid molecule
catccgcacagtaaca

SEQ ID NO: 102 - DNA, 16 bp, Artificial Sequence
  Synthetic nucleic acid molecule
cattcactcaatatgg

SEQ ID NO: 103 - DNA, 16 bp, Artificial Sequence
  Synthetic nucleic acid molecule
aagatagtcagtatat

SEQ ID NO: 104 - DNA, 16 bp, Artificial Sequence
  Synthetic nucleic acid molecule
acataggacagtatca

SEQ ID NO: 105 - DNA, 16 bp, Artificial Sequence
  Synthetic nucleic acid molecule
aatacggtctacatct

SEQ ID NO: 106 - DNA, 16 bp, Artificial Sequence
  Synthetic nucleic acid molecule
caaaatgtcagtttct

SEQ ID NO: 107 - DNA, 16 bp, Artificial Sequence
  Synthetic nucleic acid molecule
tatacatttggtatgt

SEQ ID NO: 108 - DNA, 16 bp, Artificial Sequence
  Synthetic nucleic acid molecule
tattctgtttgtatca

SEQ ID NO: 109 - DNA, 16 bp, Artificial Sequence
  Synthetic nucleic acid molecule
cagacactcagcattc

SEQ ID NO: 110 - DNA, 16 bp, Artificial Sequence
  Synthetic nucleic acid molecule
agcatacagtgtatgt

SEQ ID NO: 111 - DNA, 16 bp, Artificial Sequence
  Synthetic nucleic acid molecule
catacagtcagtatca

SEQ ID NO: 112 - DNA, 18 bp, Artificial Sequence
  Synthetic nucleic acid molecule
  misc_feature (1)..(1): n is a, c, g, or t
  misc_feature (18)..(18): n is a, c, g, or t
ntcttcattacacctgcn

SEQ ID NO: 113 - DNA, 18 bp, Artificial Sequence
  Synthetic nucleic acid molecule
  misc_feature (1)..(1): n is a, c, g, or t
  misc_feature (18)..(18): n is a, c, g, or t
ntgatactgactgtatgn

SEQ ID NO: 114 - DNA, 16 bp, Artificial Sequence
  Synthetic nucleic acid molecule
tcttcattacacctgc

SEQ ID NO: 115 - DNA, 15 bp, Artificial Sequence
  Synthetic nucleic acid molecule
tgatactgactgtat

SEQ ID NO: 116 - DNA, 18 bp, Artificial Sequence
  Synthetic nucleic acid molecule
  misc_feature (1)..(1): n is a, c, g, or t
  misc_feature (18)..(18): n is a, c, g, or t
ntcttcattacacctgcn

SEQ ID NO: 117 - DNA, 18 bp, Artificial Sequence
  Synthetic nucleic acid molecule
  misc_feature (1)..(1): n is a, c, g, or t
  misc_feature (18)..(18): n is a, c, g, or t
ntgatactgactgtatgn

SEQ ID NO: 118 - DNA, 20 bp, Artificial Sequence
  Synthetic nucleic acid molecule
ttacacctgctgatactgac

SEQ ID NO: 119 - DNA, 1104 bp, Artificial Sequence
  Synthetic nucleic acid molecule
taatacgactcactatagggagacccaagctggctagccaccatggactacaaagaccatgacggtgattataaagatcatgacatcgattacaaggatgacgatgacaagatggcccccaagaagaagaggaaggtgggcattcacggggtacccgccgctatggctgagaggcccttccagtgtcgaatctgcatgcgtaacttcagtgatcgctctaacctgagtcggcacatccgcacccacacaggcgagaagccttttgcctgtgacatttgtgggaggaagtttgccatctcctccaacctgaactcccataccaagatacacacgggatctcagaagcccttccagtgtcgaatctgcatgcgtaacttcagtcgctccgacaacctggcccgccacatccgcacccacacaggcgagaagccttttgcctgtgacatttgtgggaggaaatttgccacctccggcaacctgacccgccataccaagatacacctgcggggatcccaactagtcaaaagtgaactggaggagaagaaatctgaacttcgtcataaattgaaatatgtgcctcatgaatatattgaattaattgaaattgccagaaattccactcaggatagaattcttgaaatgaaggtaatggaattttttatgaaagtttatggatatagaggtaaacatttgggtggatcaaggaaaccggacggagcaatttatactgtcggatctcctattgattacggtgtgatcgtggatactaaagcttatagcggaggttataatctgccaattggccaagcagatgaaatgcaacgatatgtcaaagaaaatcaaacacgaaacaaacatatcaaccctaatgaatggtggaaagtctatccatcttctgtaacggaatttaagtttttatttgtgagtggtcactttaaaggaaactacaaagctcagcttacacgattaaatcataagactaattgtaatggagctgttcttagtgtagaagagcttttaattggtggagaaatgattaaagccggcacattaaccttagaggaagtgagacggaaatttaataacggcgagataaacttttaa

SEQ ID NO: 120 - protein, 353 aa, Artificial Sequence
  Synthetic polypeptide
MDYKDHDGDYKDHDIDYKDDDDKMAPKKKRKVGIHGVPAAMAERPFQCRICMRNFSDRSNLSRHIRTHTGEKPFACDICGRKFAISSNLNSHTKIHTGSQKPFQCRICMRNFSRSDNLARHIRTHTGEKPFACDICGRKFATSGNLTRHTKIHLRGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVKENQTRNKHINPNEWWKVYPSSVTEFKFLFVSGHFKGNYKAQLTRLNHKTNCNGAVLSVEELLIGGEMIKAGTLTLEEVRRKFNNGEINF

SEQ ID NO: 121 - DNA, 1101 bp, Artificial Sequence
  Synthetic nucleic acid molecule
taatacgactcactatagggagacccaagctggctagccaccatggactacaaagaccatgacggtgattataaagatcatgacatcgattacaaggatgacgatgacaagatggcccccaagaagaagaggaaggtgggcattcacggggtacctgccgctatggctgagaggcccttccagtgtcgaatctgcatgcgtaacttcagtcgctccgacaacctgtccgtgcacatccgcacccacacaggcgagaagccttttgcctgtgacatttgtgggaggaagtttgcccagaagatcaacctgcaggtgcataccaagatacacaccggcgagaagcccttccagtgtcgaatctgcatgcgtaacttcagtcgctccgacgtgctgtccgagcacatccgcacccacacaggcgagaagccttttgcctgtgacatttgtgggaggaaatttgcccagcgcaaccaccgcaccacccataccaagatacacctgcggggatcccaactagtcaaaagtgaactggaggagaagaaatctgaacttcgtcataaattgaaatatgtgcctcatgaatatattgaattaattgaaattgccagaaattccactcaggatagaattcttgaaatgaaggtaatggaattttttatgaaagtttatggatatagaggtaaacatttgggtggatcaaggaaaccggacggagcaatttatactgtcggatctcctattgattacggtgtgatcgtggatactaaagcttatagcggaggttataatctgccaattggccaagcagatgaaatggagcgatatgtcgaagaaaatcaaacacgaaacaaacatctcaaccctaatgaatggtggaaagtctatccatcttctgtaacggaatttaagtttttatttgtgagtggtcactttaaaggaaactacaaagctcagcttacacgattaaatcatatcactaattgtaatggagctgttcttagtgtagaagagcttttaattggtggagaaatgattaaagccggcacattaaccttagaggaagtgagacggaaatttaataacggcgagataaacttttaa

SEQ ID NO: 122 - protein, 352 aa, Artificial Sequence
  Synthetic polypeptide
MDYKDHDGDYKDHDIDYKDDDDKMAPKKKRKVGIHGVPAAMAERPFQCRICMRNFSRSDNLSVHIRTHTGEKPFACDICGRKFAQKINLQVHTKIHTGEKPFQCRICMRNFSRSDVLSEHIRTHTGEKPFACDICGRKFAQRNHRTTHTKIHLRGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMERYVEENQTRNKHLNPNEWWKVYPSSVTEFKFLFVSGHFKGNYKAQLTRLNHITNCNGAVLSVEELLIGGEMIKAGTLTLEEVRRKFNNGEINF

SEQ ID NO: 123 - DNA, 1017 bp, Artificial Sequence
  Synthetic nucleic acid molecule
taatacgactcactatagggagacccaagctggctagccaccatggactacaaagaccatgacggtgattataaagatcatgacatcgattacaaggatgacgatgacaagatggcccccaagaagaagaggaaggtgggcattcacggggtgccgtctagacccggggagcgccccttccagtgtcgcatttgcatgcggaacttttcgcgccaggacaggcttgacaggcatacccgtactcataccggtgaaaaaccgtttcagtgtcggatctgtatgcgaaatttctcccagaaggagcacttggcggggcatctacgtacgcacaccggcgagaagccattccaatgccgaatatgcatgcgcaacttcagtcgccgcgacaacctgaaccggcacctaaaaacccacctgaggggatcccaactagtcaaaagtgaactggaggagaagaaatctgaacttcgtcataaattgaaatatgtgcctcatgaatatattgaattaattgaaattgccagaaattccactcaggatagaattcttgaaatgaaggtaatggaattttttatgaaagtttatggatatagaggtaaacatttgggtggatcaaggaaaccggacggagcaatttatactgtcggatctcctattgattacggtgtgatcgtggatactaaagcttatagcggaggttataatctgccaattggccaagcagatgaaatgcaacgatatgtcaaagaaaatcaaacacgaaacaaacatatcaaccctaatgaatggtggaaagtctatccatcttctgtaacggaatttaagtttttatttgtgagtggtcactttaaaggaaactacaaagctcagcttacacgattaaatcataagactaattgtaatggagctgttcttagtgtagaagagcttttaattggtggagaaatgattaaagccggcacattaaccttagaggaagtgagacggaaatttaataacggcgagataaacttttaa

SEQ ID NO: 124 - protein, 324 aa, Artificial Sequence
  Synthetic polypeptide
MDYKDHDGDYKDHDIDYKDDDDKMAPKKKRKVGIHGVPSRPGERPFQCRICMRNFSRQDRLDRHTRTHTGEKPFQCRICMRNFSQKEHLAGHLRTHTGEKPFQCRICMRNFSRRDNLNRHLKTHLRGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMQRYVKENQTRNKHINPNEWWKVYPSSVTEFKFLFVSGHFKGNYKAQLTRLNHKTNCNGAVLSVEELLIGGEMIKAGTLTLEEVRRKFNNGEINF

SEQ ID NO: 125 - DNA, 1017 bp, Artificial Sequence
  Synthetic nucleic acid molecule
taatacgactcactatagggagacccaagctggctagccaccatggactacaaagaccatgacggtgattataaagatcatgacatcgattacaaggatgacgatgacaagatggcccccaagaagaagaggaaggtgggcattcacggggtgccgtctagacccggggagcgccccttccagtgtcgcatttgcatgcggaacttttcgaccggccagatccttgaccgccatacccgtactcataccggtgaaaaaccgtttcagtgtcggatctgtatgcgaaatttctccgtggcgcacagcttgaagaggcatctacgtacgcacaccggcgagaagccattccaatgccgaatatgcatgcgcaacttcagtgaccccagcaacctgcggcgccacctaaaaacccacctgaggggatcccaactagtcaaaagtgaactggaggagaagaaatctgaacttcgtcataaattgaaatatgtgcctcatgaatatattgaattaattgaaattgccagaaattccactcaggatagaattcttgaaatgaaggtaatggaattttttatgaaagtttatggatatagaggtaaacatttgggtggatcaaggaaaccggacggagcaatttatactgtcggatctcctattgattacggtgtgatcgtggatactaaagcttatagcggaggttataatctgccaattggccaagcagatgaaatggagcgatatgtcgaagaaaatcaaacacgaaacaaacatctcaaccctaatgaatggtggaaagtctatccatcttctgtaacggaatttaagtttttatttgtgagtggtcactttaaaggaaactacaaagctcagcttacacgattaaatcatatcactaattgtaatggagctgttcttagtgtagaagagcttttaattggtggagaaatgattaaagccggcacattaaccttagaggaagtgagacggaaatttaataacggcgagataaacttttaa

SEQ ID NO: 126 - protein, 324 aa, Artificial Sequence
  Synthetic polypeptide
MDYKDHDGDYKDHDIDYKDDDDKMAPKKKRKVGIHGVPSRPGERPFQCRICMRNFSTGQILDRHTRTHTGEKPFQCRICMRNFSVAHSLKRHLRTHTGEKPFQCRICMRNFSDPSNLRRHLKTHLRGSQLVKSELEEKKSELRHKLKYVPHEYIELIEIARNSTQDRILEMKVMEFFMKVYGYRGKHLGGSRKPDGAIYTVGSPIDYGVIVDTKAYSGGYNLPIGQADEMERYVEENQTRNKHLNPNEWWKVYPSSVTEFKFLFVSGHFKGNYKAQLTRLNHITNCNGAVLSVEELLIGGEMIKAGTLTLEEVRRKFNNGEINF

SEQ ID NO: 127 - DNA, 10 bp, Artificial Sequence
  Synthetic nucleic acid molecule
cgatcgttgg

SEQ ID NO: 128 - DNA, 10 bp, Artificial Sequence
  Synthetic nucleic acid molecule
cagtggaacg

SEQ ID NO: 129 - DNA, 12 bp, Artificial Sequence
  Synthetic nucleic acid molecule
gatgaggatgac

SEQ ID NO: 130 - DNA, 9 bp, Artificial Sequence
  Synthetic nucleic acid molecule
gacgctgct

SEQ ID NO: 131 - DNA, 12 bp, Artificial Sequence
  Synthetic nucleic acid molecule
aaactgcaaaag

SEQ ID NO: 132 - DNA, 9 bp, Artificial Sequence
  Synthetic nucleic acid molecule
gagtgagga

SEQ ID NO: 133 - DNA, 40 bp, Artificial Sequence
  Synthetic nucleic acid molecule
tcgttgggaaccggagctgaatgaagccataccaaacgac

SEQ ID NO: 134 - DNA, 12 bp, Artificial Sequence
  Synthetic nucleic acid molecule
gtcatcctcatc

SEQ ID NO: 135 - DNA, 12 bp, Artificial Sequence
  Synthetic nucleic acid molecule
aaactgcaaaag

SEQ ID NO: 136 - DNA, 9 bp, Artificial Sequence
  Synthetic nucleic acid molecule
agcagcgtc

SEQ ID NO: 137 - DNA, 9 bp, Artificial Sequence
  Synthetic nucleic acid molecule
gagtgagga

SEQ ID NO: 138 - DNA, 7 bp, Artificial Sequence
  Synthetic nucleic acid molecule
ccacgct

SEQ ID NO: 139 - DNA, 10 bp, Artificial Sequence
  Synthetic nucleic acid molecule
cctcgggact

SEQ ID NO: 140 - DNA, 7 bp, Artificial Sequence
  Synthetic nucleic acid molecule
ccacgct

SEQ ID NO: 141 - DNA, 10 bp, Artificial Sequence
  Synthetic nucleic acid molecule
cctcgggact

SEQ ID NO: 142 - DNA, 7 bp, Artificial Sequence
  Synthetic nucleic acid molecule
ccacgct

SEQ ID NO: 143 - DNA, 10 bp, Artificial Sequence
  Synthetic nucleic acid molecule
cctcgggact

SEQ ID NO: 144 - DNA, 7 bp, Artificial Sequence
  Synthetic nucleic acid molecule
ccacgct

SEQ ID NO: 145 - DNA, 10 bp, Artificial Sequence
  Synthetic nucleic acid molecule
cctcgggact

SEQ ID NO: 146 - DNA, 7 bp, Artificial Sequence
  Synthetic nucleic acid molecule
ccacgct

SEQ ID NO: 147 - DNA, 10 bp, Artificial Sequence
  Synthetic nucleic acid molecule
cctcgggact

SEQ ID NO: 148 - DNA, 7 bp, Artificial Sequence
  Synthetic nucleic acid molecule
ccacgct

SEQ ID NO: 149 - DNA, 10 bp, Artificial Sequence
  Synthetic nucleic acid molecule
cctcgggact

SEQ ID NO: 150 - DNA, 7 bp, Artificial Sequence
  Synthetic nucleic acid molecule
ccacgct

SEQ ID NO: 151 - DNA, 10 bp, Artificial Sequence
  Synthetic nucleic acid molecule
cctcgggact

SEQ ID NO: 152 - DNA, 7 bp, Artificial Sequence
  Synthetic nucleic acid molecule
ccacgct

SEQ ID NO: 153 - DNA, 10 bp, Artificial Sequence
  Synthetic nucleic acid molecule
cctcgggact

SEQ ID NO: 154 - DNA, 7 bp, Artificial Sequence
  Synthetic nucleic acid molecule
ccacgct

SEQ ID NO: 155 - DNA, 10 bp, Artificial Sequence
  Synthetic nucleic acid molecule
cctcgggact

SEQ ID NO: 156 - DNA, 7 bp, Artificial Sequence
  Synthetic nucleic acid molecule
ccacgct

SEQ ID NO: 157 - DNA, 10 bp, Artificial Sequence
  Synthetic nucleic acid molecule
cctcgggact

SEQ ID NO: 158 - DNA, 63 bp, Artificial Sequence
  Synthetic nucleic acid molecule
aatgatacggcgaccaccgagatctacactctttccctacacgacgctcttccgatctcgtaa

SEQ ID NO: 159 - DNA, 50 bp, Artificial Sequence
  Synthetic nucleic acid molecule
ttacgagatcggaagagcgtcgtgtagggaaagagtgtagatctcggtgg

SEQ ID NO: 160 - DNA, 63 bp, Artificial Sequence
  Synthetic nucleic acid molecule
aatgatacggcgaccaccgagatctacactctttccctacacgacgctcttccgatctgtact

SEQ ID NO: 161 - DNA, 50 bp, Artificial Sequence
  Synthetic nucleic acid molecule
agtacagatcggaagagcgtcgtgtagggaaagagtgtagatctcggtgg

SEQ ID NO: 162 - DNA, 63 bp, Artificial Sequence
  Synthetic nucleic acid molecule
aatgatacggcgaccaccgagatctacactctttccctacacgacgctcttccgatcttacga

SEQ ID NO: 163 - DNA, 50 bp, Artificial Sequence
  Synthetic nucleic acid molecule
tcgtaagatcggaagagcgtcgtgtagggaaagagtgtagatctcggtgg

SEQ ID NO: 164 - DNA, 63 bp, Artificial Sequence
  Synthetic nucleic acid molecule
aatgatacggcgaccaccgagatctacactctttccctacacgacgctcttccgatctatgct

SEQ ID NO: 165 - DNA, 50 bp, Artificial Sequence
  Synthetic nucleic acid molecule
agcatagatcggaagagcgtcgtgtagggaaagagtgtagatctcggtgg

SEQ ID NO: 166 - DNA, 63 bp, Artificial Sequence
  Synthetic nucleic acid molecule
aatgatacggcgaccaccgagatctacactctttccctacacgacgctcttccgatcttgcaa

SEQ ID NO: 167 - DNA, 50 bp, Artificial Sequence
  Synthetic nucleic acid molecule
ttgcaagatcggaagagcgtcgtgtagggaaagagtgtagatctcggtgg

SEQ ID NO: 168 - DNA, 63 bp, Artificial Sequence
  Synthetic nucleic acid molecule
aatgatacggcgaccaccgagatctacactctttccctacacgacgctcttccgatctgcatt

SEQ ID NO: 169 - DNA, 50 bp, Artificial Sequence
  Synthetic nucleic acid molecule
aatgcagatcggaagagcgtcgtgtagggaaagagtgtagatctcggtgg

SEQ ID NO: 170 - DNA, 63 bp, Artificial Sequence
  Synthetic nucleic acid molecule
aatgatacggcgaccaccgagatctacactctttccctacacgacgctcttccgatctgacta

SEQ ID NO: 171 - DNA, 50 bp, Artificial Sequence
  Synthetic nucleic acid molecule
tagtcagatcggaagagcgtcgtgtagggaaagagtgtagatctcggtgg

SEQ ID NO: 172 - DNA, 63 bp, Artificial Sequence
  Synthetic nucleic acid molecule
aatgatacggcgaccaccgagatctacactctttccctacacgacgctcttccgatctactgt

SEQ ID NO: 173 - DNA, 50 bp, Artificial Sequence
  Synthetic nucleic acid molecule
acagtagatcggaagagcgtcgtgtagggaaagagtgtagatctcggtgg

SEQ ID NO: 174 - DNA, 63 bp, Artificial Sequence
  Synthetic nucleic acid molecule
aatgatacggcgaccaccgagatctacactctttccctacacgacgctcttccgatctctgaa

SEQ ID NO: 175 - DNA, 50 bp, Artificial Sequence
  Synthetic nucleic acid molecule
ttcagagatcggaagagcgtcgtgtagggaaagagtgtagatctcggtgg

SEQ ID NO: 176 - DNA, 60 bp, Artificial Sequence
  Synthetic nucleic acid molecule
caagcagaagacggcatacgagatcgtgatgtgactggagttcagacgtgtgctcttccg

SEQ ID NO: 177 - DNA, 42 bp, Artificial Sequence
  Synthetic nucleic acid molecule
  misc_feature (22)..(25): n is a, c, g, or t
cagacgtgtgctcttccgatcnnnnagcgtggagtcccgagg

SEQ ID NO: 178 - DNA, 84 bp, Artificial Sequence
  Synthetic nucleic acid molecule
  misc_feature (64)..(67): n is a, c, g, or t
caagcagaagacggcatacgagatacagtcgtgactggagttcagacgtgtgctcttccgatcnnnnagcgtggagtcccgagg

SEQ ID NO: 179 - DNA, 73 bp, Artificial Sequence
  Synthetic nucleic acid molecule
tcgggaacgtgatcggaagagcacacgtctgaactccagtcaccgtctaatctcgtatgccgtcttctgcttg

SEQ ID NO: 180 - DNA, 38 bp, Artificial Sequence
  Synthetic nucleic acid molecule
gtgactggagttcagacgtgtgctcttccgatcacgtt

SEQ ID NO: 181 - DNA, 73 bp, Artificial Sequence
  Synthetic nucleic acid molecule
tcgggacgtagatcggaagagcacacgtctgaactccagtcaccgtctaatctcgtatgccgtcttctgcttg

SEQ ID NO: 182 - DNA, 38 bp, Artificial Sequence
  Synthetic nucleic acid molecule
gtgactggagttcagacgtgtgctcttccgatctacgt

SEQ ID NO: 183 - DNA, 73 bp, Artificial Sequence
  Synthetic nucleic acid molecule
tcgggagtacgatcggaagagcacacgtctgaactccagtcaccgtctaatctcgtatgccgtcttctgcttg

SEQ ID NO: 184 - DNA, 38 bp, Artificial Sequence
  Synthetic nucleic acid molecule
gtgactggagttcagacgtgtgctcttccgatcgtact

SEQ ID NO: 185 - DNA, 73 bp, Artificial Sequence
  Synthetic nucleic acid molecule
tcgggatacggatcggaagagcacacgtctgaactccagtcaccgtctaatctcgtatgccgtcttctgcttg

SEQ ID NO: 186 - DNA, 38 bp, Artificial Sequence
  Synthetic nucleic acid molecule
gtgactggagttcagacgtgtgctcttccgatccgtat

SEQ ID NO: 187 - DNA, 79 bp, Artificial Sequence
  Synthetic nucleic acid molecule
  misc_feature (59)..(62): n is a, c, g, or t
aatgatacggcgaccaccgagatctacactctttccctacacgacgctcttccgatctnnnncctcgggactccacgct

SEQ ID NO: 188 - DNA, 17 bp, Artificial Sequence
  Synthetic nucleic acid molecule
aatgatacggcgaccac

SEQ ID NO: 189 - DNA, 21 bp, Artificial Sequence
  Synthetic nucleic acid molecule
caagcagaagacggcatacga

SEQ ID NO: 190 - DNA, 12 bp, Artificial Sequence
  Synthetic nucleic acid molecule
gtcatcctcatc

SEQ ID NO: 191 - DNA, 12 bp, Artificial Sequence
  Synthetic nucleic acid molecule
gtcgtcctcatc

SEQ ID NO: 192 - DNA, 12 bp, Artificial Sequence
  Synthetic nucleic acid molecule
gttttcctcatc

SEQ ID NO: 193 - DNA, 12 bp, Artificial Sequence
  Synthetic nucleic acid molecule
gtcatcctcatc

SEQ ID NO: 194 - DNA, 12 bp, Artificial Sequence
  Synthetic nucleic acid molecule
taaatcctcatc

SEQ ID NO: 195 - DNA, 12 bp, Artificial Sequence
  Synthetic nucleic acid molecule
gtcatcccaatc

SEQ ID NO: 196 - DNA, 12 bp, Artificial Sequence
  Synthetic nucleic acid molecule
ctcatcctcatc

SEQ ID NO: 197 - DNA, 12 bp, Artificial Sequence
  Synthetic nucleic acid molecule
gtcatcctcagc

SEQ ID NO: 198 - DNA, 12 bp, Artificial Sequence
  Synthetic nucleic acid molecule
gtcatcttcatc

SEQ ID NO: 199 - DNA, 12 bp, Artificial Sequence
  Synthetic nucleic acid molecule
gtcatcctcatc

SEQ ID NO: 200 - DNA, 12 bp, Artificial Sequence
  Synthetic nucleic acid molecule
gtcatcttcatc

SEQ ID NO: 201 - DNA, 12 bp, Artificial Sequence
  Synthetic nucleic acid molecule
gtcatcctcata

SEQ ID NO: 202 - DNA, 12 bp, Artificial Sequence
  Synthetic nucleic acid molecule
atcatcctcatc

SEQ ID NO: 203 - DNA, 12 bp, Artificial Sequence
  Synthetic nucleic acid molecule
gtcctgctcagc

SEQ ID NO: 204 - DNA, 12 bp, Artificial Sequence
  Synthetic nucleic acid molecule
atgttcctcatc

SEQ ID NO: 205 - DNA, 12 bp, Artificial Sequence
  Synthetic nucleic acid molecule
gtcttcctgatg

SEQ ID NO: 206 - DNA, 12 bp, Artificial Sequence
  Synthetic nucleic acid molecule
aacatccacatc

SEQ ID NO: 207 - DNA, 12 bp, Artificial Sequence
  Synthetic nucleic acid molecule
atcttcctcatt

SEQ ID NO: 208 - DNA, 12 bp, Artificial Sequence
  Synthetic nucleic acid molecule
ggcttcctgacc

SEQ ID NO: 209 - DNA, 12 bp, Artificial Sequence
  Synthetic nucleic acid molecule
gttttgcacatt

SEQ ID NO: 210 - DNA, 12 bp, Artificial Sequence
  Synthetic nucleic acid molecule
gtcaacctcaac

SEQ ID NO: 211 - DNA, 12 bp, Artificial Sequence
  Synthetic nucleic acid molecule
gtcatcctcctc

SEQ ID NO: 212 - DNA, 12 bp, Artificial Sequence
  Synthetic nucleic acid molecule
gtcttcctcctc

SEQ ID NO: 213 - DNA, 12 bp, Artificial Sequence
  Synthetic nucleic acid molecule
gtgatactcatc

SEQ ID NO: 214 - DNA, 12 bp, Artificial Sequence
  Synthetic nucleic acid molecule
gttatcctcagc

SEQ ID NO: 215 - DNA, 12 bp, Artificial Sequence
  Synthetic nucleic acid molecule
ctcatgctcatc

SEQ ID NO: 216 - DNA, 12 bp, Artificial Sequence
  Synthetic nucleic acid molecule
gccagtctcagc

SEQ ID NO: 217 - DNA, 12 bp, Artificial Sequence
  Synthetic nucleic acid molecule
ctcattctgttc

SEQ ID NO: 218 - DNA, 12 bp, Artificial Sequence
  Synthetic nucleic acid molecule
gaagtcctcatc

SEQ ID NO: 219 - DNA, 12 bp, Artificial Sequence
  Synthetic nucleic acid molecule
gtcttcctcttt

SEQ ID NO: 220 - DNA, 12 bp, Artificial Sequence
  Synthetic nucleic acid molecule
ataatccttttc

SEQ ID NO: 221 - DNA, 12 bp, Artificial Sequence
  Synthetic nucleic acid molecule
gacatccaaatt

SEQ ID NO: 222 - DNA, 12 bp, Artificial Sequence
  Synthetic nucleic acid molecule
gtcttgctgttg

SEQ ID NO: 223 - DNA, 12 bp, Artificial Sequence
  Synthetic nucleic acid molecule
gtcatccgcatc

SEQ ID NO: 224 - DNA, 12 bp, Artificial Sequence
  Synthetic nucleic acid molecule
atcatcctcaac

SEQ ID NO: 225 - DNA, 12 bp, Artificial Sequence
  Synthetic nucleic acid molecule
ggaatgcccatc

SEQ ID NO: 226 - DNA, 12 bp, Artificial Sequence
  Synthetic nucleic acid molecule
gttttgctcctg

SEQ ID NO: 227 - DNA, 12 bp, Artificial Sequence
  Synthetic nucleic acid molecule
aaactgcaaaag

SEQ ID NO: 228 - DNA, 12 bp, Artificial Sequence
  Synthetic nucleic acid molecule
aaactgcaaaaa

SEQ ID NO: 229 - DNA, 12 bp, Artificial Sequence
  Synthetic nucleic acid molecule
aaactgcaaaat

SEQ ID NO: 230 - DNA, 12 bp, Artificial Sequence
  Synthetic nucleic acid molecule
aaactggctaat

SEQ ID NO: 231 - DNA, 12 bp, Artificial Sequence
  Synthetic nucleic acid molecule
aaaatgcaaaag

SEQ ID NO: 232 - DNA, 12 bp, Artificial Sequence
  Synthetic nucleic acid molecule
aaactgaaaaag

SEQ ID NO: 233 - DNA, 12 bp, Artificial Sequence
  Synthetic nucleic acid molecule
acaatgcaaaag

SEQ ID NO: 234 - DNA, 12 bp, Artificial Sequence
  Synthetic nucleic acid molecule
aaacagcagaag

SEQ ID NO: 235 - DNA, 12 bp, Artificial Sequence
  Synthetic nucleic acid molecule
gaactgcaaaac

SEQ ID NO: 236 - DNA, 12 bp, Artificial Sequence
  Synthetic nucleic acid molecule
aaagaacaaagg

SEQ ID NO: 237 - DNA, 12 bp, Artificial Sequence
  Synthetic nucleic acid molecule
aaactgtaaagt

SEQ ID NO: 238 - DNA, 12 bp, Artificial Sequence
  Synthetic nucleic acid molecule
aaactgccttag

SEQ ID NO: 239 - DNA, 12 bp, Artificial Sequence
  Synthetic nucleic acid molecule
aatgttcaaaag

SEQ ID NO: 240 - DNA, 12 bp, Artificial Sequence
  Synthetic nucleic acid molecule
aaactgaaaaag

SEQ ID NO: 241 - DNA, 12 bp, Artificial Sequence
  Synthetic nucleic acid molecule
aaactgcaaatg

SEQ ID NO: 242 - DNA, 12 bp, Artificial Sequence
  Synthetic nucleic acid molecule
aaactggaaaag

SEQ ID NO: 243 - DNA, 12 bp, Artificial Sequence
  Synthetic nucleic acid molecule
aaactgcaaaaa

SEQ ID NO: 244 - DNA, 12 bp, Artificial Sequence
  Synthetic nucleic acid molecule
aaaatgtaatag

SEQ ID NO: 245 - DNA, 12 bp, Artificial Sequence
  Synthetic nucleic acid molecule
aaactgtaaatg

SEQ ID NO: 246 - DNA, 12 bp, Artificial Sequence
  Synthetic nucleic acid molecule
taactgcaaaag

SEQ ID NO: 247 - DNA, 12 bp, Artificial Sequence
  Synthetic nucleic acid molecule
agactgcaaaag

SEQ ID NO: 248 - DNA, 12 bp, Artificial Sequence
  Synthetic nucleic acid molecule
caattgctaaag

SEQ ID NO: 249 - DNA, 12 bp, Artificial Sequence
  Synthetic nucleic acid molecule
tcactgcaaaag

SEQ ID NO: 250 - DNA, 12 bp, Artificial Sequence
  Synthetic nucleic acid molecule
aatctgcataag

SEQ ID NO: 251 - DNA, 12 bp, Artificial Sequence
  Synthetic nucleic acid molecule
aaactggaacag

SEQ ID NO: 252 - DNA, 12 bp, Artificial Sequence
  Synthetic nucleic acid molecule
taactgcaaaat

SEQ ID NO: 253 - DNA, 12 bp, Artificial Sequence
  Synthetic nucleic acid molecule
aaactgcaaaag

SEQ ID NO: 254 - DNA, 12 bp, Artificial Sequence
  Synthetic nucleic acid molecule
aaactgcaaaag

SEQ ID NO: 255 - DNA, 12 bp, Artificial Sequence
  Synthetic nucleic acid molecule
aaactgaaagag

SEQ ID NO: 256 - DNA, 12 bp, Artificial Sequence
  Synthetic nucleic acid molecule
aaaccgcaaatg

SEQ ID NO: 257 - DNA, 12 bp, Artificial Sequence
  Synthetic nucleic acid molecule
aaacagcaaaag

SEQ ID NO: 258 - DNA, 12 bp, Artificial Sequence
  Synthetic nucleic acid molecule
aaactgaaaaag

SEQ ID NO: 259 - DNA, 12 bp, Artificial Sequence
  Synthetic nucleic acid molecule
aaactgcaaaag

SEQ ID NO: 260 - DNA, 12 bp, Artificial Sequence
  Synthetic nucleic acid molecule
gaactggaaaaa

SEQ ID NO: 261 - DNA, 12 bp, Artificial Sequence
  Synthetic nucleic acid molecule
aaacaggaaaag

SEQ ID NO: 262 - DNA, 12 bp, Artificial Sequence
  Synthetic nucleic acid molecule
aaactgcaaaag

SEQ ID NO: 263 - DNA, 12 bp, Artificial Sequence
  Synthetic nucleic acid molecule
aaactgcaaaag

SEQ ID NO: 264 - DNA, 29 bp, Artificial Sequence
  Synthetic nucleic acid molecule
gtcatcctcatcctgataaactgcaaaag

SEQ ID NO: 265 - DNA, 29 bp, Artificial Sequence
  Synthetic nucleic acid molecule
gtcgtcctcatcttaataaactgcaaaaa

SEQ ID NO: 266 - DNA, 29 bp, Artificial Sequence
  Synthetic nucleic acid molecule
gttttcctcatcaaagcaaactgcaaaat

SEQ ID NO: 267 - DNA, 29 bp, Artificial Sequence
  Synthetic nucleic acid molecule
gtcatcctcatcagagaaaactggctaat

SEQ ID NO: 268 - DNA, 30 bp, Artificial Sequence
  Synthetic nucleic acid molecule
taaatcctcatctctataaaaatgcaaaag

SEQ ID NO: 269 - DNA, 30 bp, Artificial Sequence
  Synthetic nucleic acid molecule
gtcatcccaatcgaagaaaaactgaaaaag

SEQ ID NO: 270 - DNA, 29 bp, Artificial Sequence
  Synthetic nucleic acid molecule
ctcatcctcatccatgcacaatgcaaaag

SEQ ID NO: 271 - DNA, 29 bp, Artificial Sequence
  Synthetic nucleic acid molecule
gtcatcctcagcatgggaaacagcagaag

SEQ ID NO: 272 - DNA, 29 bp, Artificial Sequence
  Synthetic nucleic acid molecule
gtcatcttcatcaaaaggaactgcaaaac

SEQ ID NO: 273 - DNA, 29 bp, Artificial Sequence
  Synthetic nucleic acid molecule
gtcatcctcatccaataaaagaacaaagg

SEQ ID NO: 274 - DNA, 29 bp, Artificial Sequence
  Synthetic nucleic acid molecule
gtcatcttcatcagcataaactgtaaagt

SEQ ID NO: 275 - DNA, 29 bp, Artificial Sequence
  Synthetic nucleic acid molecule
gtcatcctcatacataaaaactgccttag

SEQ ID NO: 276 - DNA, 29 bp, Artificial Sequence
  Synthetic nucleic acid molecule
atcatcctcatccatccaatgttcaaaag

SEQ ID NO: 277 - DNA, 29 bp, Artificial Sequence
  Synthetic nucleic acid molecule
gtcctgctcagcaaaagaaactgaaaaag

SEQ ID NO: 278 - DNA, 29 bp, Artificial Sequence
  Synthetic nucleic acid molecule
atgttcctcatctcccgaaactgcaaatg

SEQ ID NO: 279 - DNA, 29 bp, Artificial Sequence
  Synthetic nucleic acid molecule
gtcttcctgatgctaccaaactggaaaag

SEQ ID NO: 280 - DNA, 29 bp, Artificial Sequence
  Synthetic nucleic acid molecule
aacatccacatcatgaaaaactgcaaaaa

SEQ ID NO: 281 - DNA, 29 bp, Artificial Sequence
  Synthetic nucleic acid molecule
atcttcctcattacaggaaaatgtaatag

SEQ ID NO: 282 - DNA, 29 bp, Artificial Sequence
  Synthetic nucleic acid molecule
ggcttcctgacccacggaaactgtaaatg

SEQ ID NO: 283 - DNA, 29 bp, Artificial Sequence
  Synthetic nucleic acid molecule
gttttgcacatttcaattaactgcaaaag

SEQ ID NO: 284 - DNA, 30 bp, Artificial Sequence
  Synthetic nucleic acid molecule
gtcaacctcaacacctacagactgcaaaag

SEQ ID NO: 285 - DNA, 30 bp, Artificial Sequence
  Synthetic nucleic acid molecule
gtcatcctcctccaactccaattgctaaag

SEQ ID NO: 286 - DNA, 30 bp, Artificial Sequence
  Synthetic nucleic acid molecule
gtcttcctcctctgcacatcactgcaaaag

SEQ ID NO: 287 - DNA, 30 bp, Artificial Sequence
  Synthetic nucleic acid molecule
gtgatactcatcatcagcaatctgcataag

SEQ ID NO: 288 - DNA, 30 bp, Artificial Sequence
  Synthetic nucleic acid molecule
gttatcctcagcaaactaaaactggaacag

SEQ ID NO: 289 - DNA, 30 bp, Artificial Sequence
  Synthetic nucleic acid molecule
ctcatgctcatcatttgttaactgcaaaat

SEQ ID NO: 290 - DNA, 30 bp, Artificial Sequence
  Synthetic nucleic acid molecule
gccagtctcagcatggtgaaactgcaaaag

SEQ ID NO: 291 - DNA, 30 bp, Artificial Sequence
  Synthetic nucleic acid molecule
ctcattctgttcatgaaaaaactgcaaaag

SEQ ID NO: 292 - DNA, 30 bp, Artificial Sequence
  Synthetic nucleic acid molecule
gaagtcctcatcccgaagaaactgaaagag

SEQ ID NO: 293 - DNA, 30 bp, Artificial Sequence
  Synthetic nucleic acid molecule
gtcttcctctttcacataaaaccgcaaatg

SEQ ID NO: 294 - DNA, 30 bp, Artificial Sequence
  Synthetic nucleic acid molecule
ataatccttttctgtttaaaacagcaaaag

SEQ ID NO: 295 - DNA, 30 bp, Artificial Sequence
  Synthetic nucleic acid molecule
gacatccaaattacatggaaactgaaaaag

SEQ ID NO: 296 - DNA, 30 bp, Artificial Sequence
  Synthetic nucleic acid molecule
gtcttgctgttgcacctcaaactgcaaaag

SEQ ID NO: 297 - DNA, 30 bp, Artificial Sequence
  Synthetic nucleic acid molecule
gtcatccgcatcgccctggaactggaaaaa

SEQ ID NO: 298 - DNA, 30 bp, Artificial Sequence
  Synthetic nucleic acid molecule
atcatcctcaacaaactaaaacaggaaaag

SEQ ID NO: 299 - DNA, 30 bp, Artificial Sequence
  Synthetic nucleic acid molecule
ggaatgcccatcaccacaaaactgcaaaag

SEQ ID NO: 300 - DNA, 30 bp, Artificial Sequence
  Synthetic nucleic acid molecule
gttttgctcctgtacttcaaactgcaaaag

SEQ ID NO: 301 - DNA, 29 bp, Artificial Sequence
  Synthetic nucleic acid molecule
attttgcagtttgctttgatgaggaaaac

SEQ ID NO: 302 - DNA, 29 bp, Artificial Sequence
  Synthetic nucleic acid molecule
attttgcagtttgctttgatgaggaaaac

SEQ ID NO: 303 - DNA, 34 bp, Artificial Sequence
  Synthetic nucleic acid molecule
attttgcagtttgctttgctttgatgaggaaaac

SEQ ID NO: 304 - DNA, 34 bp, Artificial Sequence
  Synthetic nucleic acid molecule
attttgcagtttggtttgctttgatgaggaaaac

SEQ ID NO: 305 - DNA, 34 bp, Artificial Sequence
  Synthetic nucleic acid molecule
attttgcagtttgctttgctttggtgaggaaaac

SEQ ID NO: 306 - DNA, 34 bp, Artificial Sequence
  Synthetic nucleic acid molecule
gttttgcagtttgctttgctttgatgaggaaaac

SEQ ID NO: 307 - DNA, 34 bp, Artificial Sequence
  Synthetic nucleic acid molecule
cttttgcaggttgctttgctttgatgaggaaaac

SEQ ID NO: 308 - DNA, 34 bp, Artificial Sequence
  Synthetic nucleic acid molecule
attttgcagtttgctttgctttgatgtggaaaac

SEQ ID NO: 309 - DNA, 29 bp, Artificial Sequence
  Synthetic nucleic acid molecule
attttgcagtttgctttgatgaggaaaac

SEQ ID NO: 310 - DNA, 29 bp, Artificial Sequence
  Synthetic nucleic acid molecule
gttttgcagttccttttgatgaagatgac

SEQ ID NO: 311 - DNA, 29 bp, Artificial Sequence
  Synthetic nucleic acid molecule
gttttgcagttccttttgatgaagatgac

SEQ ID NO: 312 - DNA, 29 bp, Artificial Sequence
  Synthetic nucleic acid molecule
gttttgcaggtccttttgatgaagatgac

SEQ ID NO: 313 - DNA, 29 bp, Artificial Sequence
  Synthetic nucleic acid molecule
actttacagtttatgctgatgaagatgac

SEQ ID NO: 314 - DNA, 29 bp, Artificial Sequence
  Synthetic nucleic acid molecule
actttacagtttatgctgatgaagatgac

SEQ ID NO: 315 - DNA, 29 bp, Artificial Sequence
  Synthetic nucleic acid molecule
actttacagtttatgctgatgaagatgac

SEQ ID NO: 316 - DNA, 29 bp, Artificial Sequence
  Synthetic nucleic acid molecule
gctttacagtttatgctgatgaagatgac

SEQ ID NO: 317 - DNA, 29 bp, Artificial Sequence
  Synthetic nucleic acid molecule
actttacagtttatgctgatgaagaatac

SEQ ID NO: 318 - DNA, 29 bp, Artificial Sequence
  Synthetic nucleic acid molecule
actttacagtttatgctgatgaagatgtt

SEQ ID NO: 319 - DNA, 29 bp, Artificial Sequence
  Synthetic nucleic acid molecule
actttacagtttatgctgatgaagatgac

SEQ ID NO: 320 - DNA, 29 bp, Artificial Sequence
  Synthetic nucleic acid molecule
actttacggtttatgctgatgaagatgac

SEQ ID NO: 321 - DNA, 29 bp, Artificial Sequence
  Synthetic nucleic acid molecule
actttacagtttatgctgatgaagatgac

SEQ ID NO: 322 - DNA, 29 bp, Artificial Sequence
  Synthetic nucleic acid molecule
actttacagtttatgctgatgaagatgcc

SEQ ID NO: 323 - DNA, 34 bp, Artificial Sequence
  Synthetic nucleic acid molecule
actttacagtttatgctatgctgatgaagatgac

SEQ ID NO: 324 - DNA, 34 bp, Artificial Sequence
  Synthetic nucleic acid molecule
gctttacagtttatgctatgctgatgaagatgac

SEQ ID NO: 325 - DNA, 34 bp, Artificial Sequence
  Synthetic nucleic acid molecule
actttacggtttatgctatgctgatgaagatgac

SEQ ID NO: 326 - DNA, 34 bp, Artificial Sequence
  Synthetic nucleic acid molecule
actttacagtttatgctatgctgatgatgatgac

SEQ ID NO: 327 - DNA, 34 bp, Artificial Sequence
  Synthetic nucleic acid molecule
acgttacagtttatgctatgctgatgaagatgac

SEQ ID NO: 328 - DNA, 29 bp, Artificial Sequence
  Synthetic nucleic acid molecule
actttacagtttatgctgatgaagatgac

SEQ ID NO: 329 - DNA, 29 bp, Artificial Sequence
  Synthetic nucleic acid molecule
actttacagtttatgctgatgaagatgtc

SEQ ID NO: 330 - DNA, 30 bp, Artificial Sequence; identical to SEQ ID NO: 288
  Synthetic nucleic acid molecule

SEQ ID NO: 331 - DNA, 34 bp, Artificial Sequence
  Synthetic nucleic acid molecule
gttatcctcagcaaactaactaaaactggaacag

SEQ ID NO: 332 - DNA, 30 bp, Artificial Sequence; identical to SEQ ID NO: 288
  Synthetic nucleic acid molecule

SEQ ID NO: 333 - DNA, 30 bp, Artificial Sequence
  Synthetic nucleic acid molecule
gttatcctcagcaaactaaaactgggacag

SEQ ID NO: 334 - DNA, 30 bp, Artificial Sequence
  Synthetic nucleic acid molecule
gttatcctcagcaaactaaaactggaccag

SEQ ID NO: 335 - DNA, 30 bp, Artificial Sequence
  Synthetic nucleic acid molecule
gttatactcagcaaactaaaactggaacag

SEQ ID NO: 336 - DNA, 30 bp, Artificial Sequence; identical to SEQ ID NO: 288
  Synthetic nucleic acid molecule

SEQ ID NO: 337 - DNA, 30 bp, Artificial Sequence
  Synthetic nucleic acid molecule
attatcctcagcaaactaaaactggaacag

SEQ ID NO: 338 - DNA, 30 bp, Artificial Sequence
  Synthetic nucleic acid molecule
gttatccttagcaaactaaaactggaacag

SEQ ID NO: 339 - DNA, 30 bp, Artificial Sequence; identical to SEQ ID NO: 288
  Synthetic nucleic acid molecule

SEQ ID NO: 340 - DNA, 30 bp, Artificial Sequence
  Synthetic nucleic acid molecule
gatatcctcagcaaactaaaactggaacag

SEQ ID NO: 341 - DNA, 29 bp, Artificial Sequence
  Synthetic nucleic acid molecule
ctttttcagtttcttttgctgagcaggac

SEQ ID NO: 342 - DNA, 29 bp, Artificial Sequence
  Synthetic nucleic acid molecule
ctttttcagtttcttttgctgagcaggac

SEQ ID NO: 343 - DNA, 29 bp, Artificial Sequence
  Synthetic nucleic acid molecule
catttgcagtttcgggagatgaggaacat

SEQ ID NO: 344 - DNA, 31 bp, Artificial Sequence
  Synthetic nucleic acid molecule
catttgcagtttcgggagagatgaggaacat

SEQ ID NO: 345 - DNA, 31 bp, Artificial Sequence
  Synthetic nucleic acid molecule
catttgcagttacgggagagatgaggaacat

SEQ ID NO: 346 - DNA, 31 bp, Artificial Sequence
  Synthetic nucleic acid molecule
catttgcagtttcgggagagatgagggacat

SEQ ID NO: 347 - DNA, 31 bp, Artificial Sequence
  Synthetic nucleic acid molecule
catttgacgcttcgggagaggtgagggacat

SEQ ID NO: 348 - DNA, 33 bp, Artificial Sequence
  Synthetic nucleic acid molecule
catttgcagtttcgggcgggagatgaggaacat

SEQ ID NO: 349 - DNA, 33 bp, Artificial Sequence
  Synthetic nucleic acid molecule
catttgcagtttcgggcgggagatgcggaacat

SEQ ID NO: 350 - DNA, 33 bp, Artificial Sequence
  Synthetic nucleic acid molecule
catttgcagtttcgggcgggcgatgaggaacat

SEQ ID NO: 351 - DNA, 33 bp, Artificial Sequence
  Synthetic nucleic acid molecule
catttgcagtttcgggcgggaggtgaggaacat

SEQ ID NO: 352 - DNA, 33 bp, Artificial Sequence
  Synthetic nucleic acid molecule
cgtttgcagtttcgggcgggagatgaggaacat

SEQ ID NO: 353 - DNA, 33 bp, Artificial Sequence
  Synthetic nucleic acid molecule
catttgctgtttcgggcgggagatgaggaacat

SEQ ID NO: 354 - DNA, 33 bp, Artificial Sequence
  Synthetic nucleic acid molecule
catttgcagtttcgggcgggagatgaggaccat

SEQ ID NO: 355 - DNA, 33 bp, Artificial Sequence; identical to SEQ ID NO: 351
  Synthetic nucleic acid molecule

SEQ ID NO: 356 - DNA, 33 bp, Artificial Sequence
  Synthetic nucleic acid molecule
cctttgcagtttcgggcgggagatgaggaacat

SEQ ID NO: 357 - DNA, 33 bp, Artificial Sequence
  Synthetic nucleic acid molecule
catttgcagttgcgggcgggagatgaggaacat

SEQ ID NO: 358 - DNA, 29 bp, Artificial Sequence
  Synthetic nucleic acid molecule
gtcttcctgatgctaccaaactggaaaag

SEQ ID NO: 359 - DNA, 29 bp, Artificial Sequence
  Synthetic nucleic acid molecule
gtcttcctgatgctaccaaactggaaaag

SEQ ID NO: 360 - DNA, 29 bp, Artificial Sequence
  Synthetic nucleic acid molecule
gtcttcctgatgctaccaaacttgaaaag

SEQ ID NO: 361 - DNA, 29 bp, Artificial Sequence
  Synthetic nucleic acid molecule
gtcttcatgatgctaccaaactggaaaag

SEQ ID NO: 362 - DNA, 30 bp, Artificial Sequence
  Synthetic nucleic acid molecule
cttttgcagtctgtaggtgttgaggttgac

SEQ ID NO: 363 - DNA, 30 bp, Artificial Sequence; identical to SEQ ID NO: 362
  Synthetic nucleic acid molecule

SEQ ID NO: 364 - DNA, 30 bp, Artificial Sequence; identical to SEQ ID NO: 362
  Synthetic nucleic acid molecule

SEQ ID NO: 365 - DNA, 30 bp, Artificial Sequence; identical to SEQ ID NO: 362
  Synthetic nucleic acid molecule

SEQ ID NO: 366 - DNA, 9 bp, Artificial Sequence
  Synthetic nucleic acid molecule
agcagcgtc

SEQ ID NO: 367 - DNA, 9 bp, Artificial Sequence
  Synthetic nucleic acid molecule
agcagcgtc

SEQ ID NO: 368 - DNA, 9 bp, Artificial Sequence
  Synthetic nucleic acid molecule
agcagcctc

SEQ ID NO: 369 - DNA, 9 bp, Artificial Sequence
  Synthetic nucleic acid molecule
agcagcgtt

SEQ ID NO: 370 - DNA, 9 bp, Artificial Sequence
  Synthetic nucleic acid molecule
agcagcgtc

SEQ ID NO: 371 - DNA, 9 bp, Artificial Sequence
  Synthetic nucleic acid molecule
agcagcgtc

SEQ ID NO: 372 - DNA, 9 bp, Artificial Sequence
  Synthetic nucleic acid molecule
agcagcgtc

SEQ ID NO: 373 - DNA, 9 bp, Artificial Sequence
  Synthetic nucleic acid molecule
agcagcgtc

SEQ ID NO: 374 - DNA, 9 bp, Artificial Sequence
  Synthetic nucleic acid molecule
agcagcgtc

SEQ ID NO: 375 - DNA, 9 bp, Artificial Sequence
  Synthetic nucleic acid molecule
agcagcgtc

SEQ ID NO: 376 - DNA, 9 bp, Artificial Sequence
  Synthetic nucleic acid molecule
agcagcgtc

SEQ ID NO: 377 - DNA, 9 bp, Artificial Sequence
  Synthetic nucleic acid molecule
agcagcgtc

SEQ ID NO: 378 - DNA, 9 bp, Artificial Sequence
  Synthetic nucleic acid molecule
agaagcgtc

SEQ ID NO: 379 - DNA, 9 bp, Artificial Sequence
  Synthetic nucleic acid molecule
agcaacgtc

SEQ ID NO: 380 - DNA, 9 bp, Artificial Sequence
  Synthetic nucleic acid molecule
agcaacgtc

SEQ ID NO: 381 - DNA, 9 bp, Artificial Sequence
  Synthetic nucleic acid molecule
agcaacgtc

SEQ ID NO: 382 - DNA, 9 bp, Artificial Sequence
  Synthetic nucleic acid molecule
agcaccgtc

SEQ ID NO: 383 - DNA, 9 bp, Artificial Sequence
  Synthetic nucleic acid molecule
agcagagtc

SEQ ID NO: 384 - DNA, 9 bp, Artificial Sequence
  Synthetic nucleic acid molecule
agcagagtc

SEQ ID NO: 385 - DNA, 9 bp, Artificial Sequence
  Synthetic nucleic acid molecule
agcagcatc

SEQ ID NO: 386 - DNA, 9 bp, Artificial Sequence
  Synthetic nucleic acid molecule
agcagcctc

SEQ ID NO: 387 - DNA, 9 bp, Artificial Sequence
  Synthetic nucleic acid molecule
agcagcctc

SEQ ID NO: 388 - DNA, 9 bp, Artificial Sequence
  Synthetic nucleic acid molecule
agcagcgac

SEQ ID NO: 389 - DNA, 9 bp, Artificial Sequence
  Synthetic nucleic acid molecule
agcagcgtg

SEQ ID NO: 390 - DNA, 9 bp, Artificial Sequence
  Synthetic nucleic acid molecule
agcagcttc

SEQ ID NO: 391 - DNA, 9 bp, Artificial Sequence
  Synthetic nucleic acid molecule
agcagcttc

SEQ ID NO: 392 - DNA, 9 bp, Artificial Sequence
  Synthetic nucleic acid molecule
agcagcttc

SEQ ID NO: 393 - DNA, 9 bp, Artificial Sequence
  Synthetic nucleic acid molecule
agcagggtc

SEQ ID NO: 394 - DNA, 9 bp, Artificial Sequence
  Synthetic nucleic acid molecule
agcagtgtc

SEQ ID NO: 395 - DNA, 9 bp, Artificial Sequence
  Synthetic nucleic acid molecule
agcagtgtc

SEQ ID NO: 396 - DNA, 9 bp, Artificial Sequence
  Synthetic nucleic acid molecule
agcagtgtc

SEQ ID NO: 397 - DNA, 9 bp, Artificial Sequence
  Synthetic nucleic acid molecule
agcagtgtc

SEQ ID NO: 398 - DNA, 9 bp, Artificial Sequence
  Synthetic nucleic acid molecule
agcagtgtc

SEQ ID NO: 399 - DNA, 9 bp, Artificial Sequence
  Synthetic nucleic acid molecule
agcagtgtc

SEQ ID NO: 400 - DNA, 9 bp, Artificial Sequence
  Synthetic nucleic acid molecule
agcatcgtc

SEQ ID NO: 401 - DNA, 9 bp, Artificial Sequence
  Synthetic nucleic acid molecule
agcatcgtc

SEQ ID NO: 402 - DNA, 9 bp, Artificial Sequence
  Synthetic nucleic acid molecule
agcatcgtc

SEQ ID NO: 403 - DNA, 9 bp, Artificial Sequence
  Synthetic nucleic acid molecule
aggagcgtc

SEQ ID NO: 404 - DNA, 9 bp, Artificial Sequence
  Synthetic nucleic acid molecule
aacagcttc

SEQ ID NO: 405 - DNA, 9 bp, Artificial Sequence
  Synthetic nucleic acid molecule
aacagcttc

SEQ ID NO: 406 - DNA, 9 bp, Artificial Sequence
  Synthetic nucleic acid molecule
aacagcttc

SEQ ID NO: 407 - DNA, 9 bp, Artificial Sequence
  Synthetic nucleic acid molecule
agcaaagtc

SEQ ID NO: 408 - DNA, 9 bp, Artificial Sequence
  Synthetic nucleic acid molecule
agcaacttc

SEQ ID NO: 409 - DNA, 9 bp, Artificial Sequence
  Synthetic nucleic acid molecule
agcaccttc

SEQ ID NO: 410 - DNA, 9 bp, Artificial Sequence
  Synthetic nucleic acid molecule
agcagcata

SEQ ID NO: 411 - DNA, 9 bp, Artificial Sequence
  Synthetic nucleic acid molecule
agcagcata

SEQ ID NO: 412 - DNA, 9 bp, Artificial Sequence
  Synthetic nucleic acid molecule
agcagcata

SEQ ID NO: 413 - DNA, 9 bp, Artificial Sequence
  Synthetic nucleic acid molecule
agcagcgag

SEQ ID NO: 414 - DNA, 9 bp, Artificial Sequence
  Synthetic nucleic acid molecule
agcagcggt

SEQ ID NO: 415 - DNA, 9 bp, Artificial Sequence
  Synthetic nucleic acid molecule
agcagggtt

SEQ ID NO: 416 - DNA, 9 bp, Artificial Sequence
  Synthetic nucleic acid molecule
agctgagtc

SEQ ID NO: 417 - DNA, 9 bp, Artificial Sequence
  Synthetic nucleic acid molecule
agctgagtc

SEQ ID NO: 418 - DNA, 9 bp, Artificial Sequence
  Synthetic nucleic acid molecule
agctgggtc

SEQ ID NO: 419 - DNA, 9 bp, Artificial Sequence
  Synthetic nucleic acid molecule
agctgggtc

SEQ ID NO: 420 - DNA, 9 bp, Artificial Sequence
  Synthetic nucleic acid molecule
agctgtgtc

SEQ ID NO: 421 - DNA, 9 bp, Artificial Sequence
  Synthetic nucleic acid molecule
agctgtgtc

SEQ ID NO: 422 - DNA, 9 bp, Artificial Sequence
  Synthetic nucleic acid molecule
agtagcggc

SEQ ID NO: 423 - DNA, 9 bp, Artificial Sequence
  Synthetic nucleic acid molecule
agtggcgtc

SEQ ID NO: 424 - DNA, 9 bp, Artificial Sequence
  Synthetic nucleic acid molecule
ggcagagtc

SEQ ID NO: 425 - DNA, 9 bp, Artificial Sequence
  Synthetic nucleic acid molecule
tccagcgtc

SEQ ID NO: 426 - DNA, 9 bp, Artificial Sequence
  Synthetic nucleic acid molecule
tgcagcggc

SEQ ID NO: 427 - DNA, 9 bp, Artificial Sequence
  Synthetic nucleic acid molecule
tgcagcgtt

SEQ ID NO: 428 - DNA, 9 bp, Artificial Sequence
  Synthetic nucleic acid molecule
tgcagggtc

SEQ ID NO: 429 - DNA, 9 bp, Artificial Sequence
  Synthetic nucleic acid molecule
tgcagtgtc

SEQ ID NO: 430 - DNA, 9 bp, Artificial Sequence
  Synthetic nucleic acid molecule
agcaacgtc

SEQ ID NO: 431 - DNA, 9 bp, Artificial Sequence
  Synthetic nucleic acid molecule
agcaacgtc

SEQ ID NO: 432 - DNA, 9 bp, Artificial Sequence
  Synthetic nucleic acid molecule
agcaccgtc

SEQ ID NO: 433 - DNA, 9 bp, Artificial Sequence
  Synthetic nucleic acid molecule
agcagcggc

SEQ ID NO: 434 - DNA, 9 bp, Artificial Sequence
  Synthetic nucleic acid molecule
agcagcggc

SEQ ID NO: 435 - DNA, 9 bp, Artificial Sequence
  Synthetic nucleic acid molecule
agcagtgtc

SEQ ID NO: 436 - DNA, 9 bp, Artificial Sequence
  Synthetic nucleic acid molecule
agaaacgtc

SEQ ID NO: 437 - DNA, 9 bp, Artificial Sequence
  Synthetic nucleic acid molecule
agcaaagtc

SEQ ID NO: 438 - DNA, 9 bp, Artificial Sequence
  Synthetic nucleic acid molecule
agcaacatc

SEQ ID NO: 439 - DNA, 9 bp, Artificial Sequence
  Synthetic nucleic acid molecule
agcaacatc

SEQ ID NO: 440 - DNA, 9 bp, Artificial Sequence
  Synthetic nucleic acid molecule
agcaacttc

SEQ ID NO: 441 - DNA, 9 bp, Artificial Sequence
  Synthetic nucleic acid molecule
agcaacttc

SEQ ID NO: 442 - DNA, 9 bp, Artificial Sequence
  Synthetic nucleic acid molecule
agcaatgtc

SEQ ID NO: 443 - DNA, 9 bp, Artificial Sequence
  Synthetic nucleic acid molecule
agcaccgtg

SEQ ID NO: 444 - DNA, 9 bp, Artificial Sequence
  Synthetic nucleic acid molecule
agcacggtc

SEQ ID NO: 445 - DNA, 9 bp, Artificial Sequence
  Synthetic nucleic acid molecule
agcagcagc

SEQ ID NO: 446 - DNA, 9 bp, Artificial Sequence
  Synthetic nucleic acid molecule
agcagcagc

SEQ ID NO: 447 - DNA, 9 bp, Artificial Sequence
  Synthetic nucleic acid molecule
agcagctcc

SEQ ID NO: 448 - DNA, 9 bp, Artificial Sequence
  Synthetic nucleic acid molecule
agcagggtg

SEQ ID NO: 449 - DNA, 9 bp, Artificial Sequence
  Synthetic nucleic acid molecule
agcatagtc

SEQ ID NO: 450 - DNA, 9 bp, Artificial Sequence
  Synthetic nucleic acid molecule
agcatggtc

SEQ ID NO: 451 - DNA, 9 bp, Artificial Sequence
  Synthetic nucleic acid molecule
agcattgtc

SEQ ID NO: 452 - DNA, 9 bp, Artificial Sequence
  Synthetic nucleic acid molecule
agcattgtc

SEQ ID NO: 453 - DNA, 9 bp, Artificial Sequence
  Synthetic nucleic acid molecule
agtagcgtt

SEQ ID NO: 454 - DNA, 9 bp, Artificial Sequence
  Synthetic nucleic acid molecule
atcagagtc

SEQ ID NO: 455 - DNA, 9 bp, Artificial Sequence
  Synthetic nucleic acid molecule
atcagtgtc

SEQ ID NO: 456 - DNA, 9 bp, Artificial Sequence
  Synthetic nucleic acid molecule
ggcagagtc

SEQ ID NO: 457 - DNA, 9 bp, Artificial Sequence
  Synthetic nucleic acid molecule
ggcagcggc

SEQ ID NO: 458 - DNA, 9 bp, Artificial Sequence
  Synthetic nucleic acid molecule
tgcagcttc

SEQ ID NO: 459 - DNA, 9 bp, Artificial Sequence
  Synthetic nucleic acid molecule
agcatagtt

SEQ ID NO: 460 - DNA, 9 bp, Artificial Sequence
  Synthetic nucleic acid molecule
agtaaagtc

SEQ ID NO: 461 - DNA, 9 bp, Artificial Sequence
  Synthetic nucleic acid molecule
tgcagtctc

SEQ ID NO: 462 - DNA, 9 bp, Artificial Sequence
  Synthetic nucleic acid molecule
gagtgagga

SEQ ID NO: 463 - DNA, 9 bp, Artificial Sequence
  Synthetic nucleic acid molecule
gagtgaaga

SEQ ID NO: 464 - DNA, 9 bp, Artificial Sequence
  Synthetic nucleic acid molecule
gagtgagga

SEQ ID NO: 465 - DNA, 9 bp, Artificial Sequence
  Synthetic nucleic acid molecule
gagtgagga

SEQ ID NO: 466 - DNA, 9 bp, Artificial Sequence
  Synthetic nucleic acid molecule
cagtgagca

SEQ ID NO: 467 - DNA, 9 bp, Artificial Sequence
  Synthetic nucleic acid molecule
gtgtgaggt

SEQ ID NO: 468 - DNA, 9 bp, Artificial Sequence
  Synthetic nucleic acid molecule
aagtgggga

SEQ ID NO: 469 - DNA, 9 bp, Artificial Sequence
  Synthetic nucleic acid molecule
gagggaaga

SEQ ID NO: 470 - DNA, 9 bp, Artificial Sequence
  Synthetic nucleic acid molecule
gagggaggg

SEQ ID NO: 471 - DNA, 9 bp, Artificial Sequence
  Synthetic nucleic acid molecule
gagtgtgca

SEQ ID NO: 472 - DNA, 9 bp, Artificial Sequence
  Synthetic nucleic acid molecule
gagtgatgg

SEQ ID NO: 473 - DNA, 9 bp, Artificial Sequence
  Synthetic nucleic acid molecule
gagtgaaaa

SEQ ID NO: 474 - DNA, 9 bp, Artificial Sequence
  Synthetic nucleic acid molecule
gagtgaggt

SEQ ID NO: 475 - DNA, 9 bp, Artificial Sequence
  Synthetic nucleic acid molecule
gggtgagga

SEQ ID NO: 476 - DNA, 9 bp, Artificial Sequence
  Synthetic nucleic acid molecule
cagtgagga

SEQ ID NO: 477 - DNA, 9 bp, Artificial Sequence
  Synthetic nucleic acid molecule
gattgagga

SEQ ID NO: 478 - DNA, 9 bp, Artificial Sequence
  Synthetic nucleic acid molecule
tagtgagga

SEQ ID NO: 479 - DNA, 9 bp, Artificial Sequence
  Synthetic nucleic acid molecule
gagtgaggt

SEQ ID NO: 480 - DNA, 9 bp, Artificial Sequence
  Synthetic nucleic acid molecule
gagtgaggc

SEQ ID NO: 481 - DNA, 9 bp, Artificial Sequence
  Synthetic nucleic acid molecule
gagtgaggc

SEQ ID NO: 482 - DNA, 9 bp, Artificial Sequence
  Synthetic nucleic acid molecule
gagtgaggc

SEQ ID NO: 483 - DNA, 9 bp, Artificial Sequence
  Synthetic nucleic acid molecule
gagtgaggt

SEQ ID NO: 484 - DNA, 9 bp, Artificial Sequence
  Synthetic nucleic acid molecule
gagtgaggt

SEQ ID NO: 485 - DNA, 9 bp, Artificial Sequence
  Synthetic nucleic acid molecule
gagtgaggc

SEQ ID NO: 486 - DNA, 9 bp, Artificial Sequence
  Synthetic nucleic acid molecule
gtgtgagga

SEQ ID NO: 487 - DNA, 9 bp, Artificial Sequence
  Synthetic nucleic acid molecule
gagtgagaa

SEQ ID NO: 488 - DNA, 9 bp, Artificial Sequence
  Synthetic nucleic acid molecule
gagtgaggg

SEQ ID NO: 489 - DNA, 9 bp, Artificial Sequence
  Synthetic nucleic acid molecule
gagtgaggc

SEQ ID NO: 490 - DNA, 9 bp, Artificial Sequence
  Synthetic nucleic acid molecule
gtgtgagga

SEQ ID NO: 491 - DNA, 9 bp, Artificial Sequence
  Synthetic nucleic acid molecule
gtgtgagga

SEQ ID NO: 492 - DNA, 9 bp, Artificial Sequence
  Synthetic nucleic acid molecule
gtgtgagga

SEQ ID NO: 493 - DNA, 9 bp, Artificial Sequence
  Synthetic nucleic acid molecule
gtgtgagga

SEQ ID NO: 494 - DNA, 9 bp, Artificial Sequence
  Synthetic nucleic acid molecule
gtgtgagga

SEQ ID NO: 495 - DNA, 9 bp, Artificial Sequence
  Synthetic nucleic acid molecule
gggtgagga

SEQ ID NO: 496 - DNA, 9 bp, Artificial Sequence
  Synthetic nucleic acid molecule
cagtgagga

SEQ ID NO: 497 - DNA, 9 bp, Artificial Sequence
  Synthetic nucleic acid molecule
gagtgaggc

SEQ ID NO: 498 - DNA, 9 bp, Artificial Sequence
  Synthetic nucleic acid molecule
gagtgagta

SEQ ID NO: 499 - DNA, 9 bp, Artificial Sequence
  Synthetic nucleic acid molecule
gagtgaggc

SEQ ID NO: 500 - DNA, 9 bp, Artificial Sequence
  Synthetic nucleic acid molecule
gagtgagga

SEQ ID NO: 501 - DNA, 9 bp, Artificial Sequence
  Synthetic nucleic acid molecule
gagtgagga

SEQ ID NO: 502 - DNA, 9 bp, Artificial Sequence
  Synthetic nucleic acid molecule
gagtgagga

SEQ ID NO: 503 - DNA, 9 bp, Artificial Sequence
  Synthetic nucleic acid molecule
gagtgagga

SEQ ID NO: 504 - DNA, 9 bp, Artificial Sequence
  Synthetic nucleic acid molecule
gagtgagga

SEQ ID NO: 505 - DNA, 9 bp, Artificial Sequence
  Synthetic nucleic acid molecule
gagtgagga

SEQ ID NO: 506 - DNA, 9 bp, Artificial Sequence
  Synthetic nucleic acid molecule
gagtgagga

SEQ ID NO: 507 - DNA, 9 bp, Artificial Sequence
  Synthetic nucleic acid molecule
gagtgagga

SEQ ID NO: 508 - DNA, 9 bp, Artificial Sequence
  Synthetic nucleic acid molecule
gagtgagga

SEQ ID NO: 509 - DNA, 9 bp, Artificial Sequence
  Synthetic nucleic acid molecule
gagtgagga

SEQ ID NO: 510 - DNA, 9 bp, Artificial Sequence
  Synthetic nucleic acid molecule
gagtgagga

SEQ ID NO: 511 - DNA, 9 bp, Artificial Sequence
  Synthetic nucleic acid molecule
gagtgagga

SEQ ID NO: 512 - DNA, 9 bp, Artificial Sequence
  Synthetic nucleic acid molecule
gagtgagga

SEQ ID NO: 513 - DNA, 9 bp, Artificial Sequence
  Synthetic nucleic acid molecule
gagtgagga

SEQ ID NO: 514 - DNA, 9 bp, Artificial Sequence
  Synthetic nucleic acid molecule
gagtgagga

SEQ ID NO: 515 - DNA, 9 bp, Artificial Sequence
  Synthetic nucleic acid molecule
gagtgagga

SEQ ID NO: 516 - DNA, 9 bp, Artificial Sequence
  Synthetic nucleic acid molecule
gagtgagga

SEQ ID NO: 517 - DNA, 9 bp, Artificial Sequence
  Synthetic nucleic acid molecule
gagtgagga

SEQ ID NO: 518 - DNA, 9 bp, Artificial Sequence
  Synthetic nucleic acid molecule
gagtgagga

SEQ ID NO: 519 - DNA, 9 bp, Artificial Sequence
  Synthetic nucleic acid molecule
gagtgagga

SEQ ID NO: 520 - DNA, 9 bp, Artificial Sequence
  Synthetic nucleic acid molecule
gagtgagga

SEQ ID NO: 521 - DNA, 9 bp, Artificial Sequence
  Synthetic nucleic acid molecule
gagtgagga

SEQ ID NO: 522 - DNA, 9 bp, Artificial Sequence
  Synthetic nucleic acid molecule
gagtgagga

SEQ ID NO: 523 - DNA, 9 bp, Artificial Sequence
  Synthetic nucleic acid molecule
gagtgagga

SEQ ID NO: 524 - DNA, 9 bp, Artificial Sequence
  Synthetic nucleic acid molecule
gagtgagga

SEQ ID NO: 525 - DNA, 9 bp, Artificial Sequence
  Synthetic nucleic acid molecule
gagtgagga

SEQ ID NO: 526 - DNA, 9 bp, Artificial Sequence
  Synthetic nucleic acid molecule
gtgtgagaa

SEQ ID NO: 527 - DNA, 9 bp, Artificial Sequence
  Synthetic nucleic acid molecule
gagtgttga

SEQ ID NO: 528 - DNA, 9 bp, Artificial Sequence
  Synthetic nucleic acid molecule
cagtgaggc

SEQ ID NO: 529 - DNA, 9 bp, Artificial Sequence
  Synthetic nucleic acid molecule
cagtgaggc

SEQ ID NO: 530 - DNA, 9 bp, Artificial Sequence
  Synthetic nucleic acid molecule
gggtgaggt

SEQ ID NO: 531 - DNA, 9 bp, Artificial Sequence
  Synthetic nucleic acid molecule
gagtgagat

SEQ ID NO: 532 - DNA, 9 bp, Artificial Sequence
  Synthetic nucleic acid molecule
gagtgaggg

SEQ ID NO: 533 - DNA, 9 bp, Artificial Sequence
  Synthetic nucleic acid molecule
gagtgaggg

SEQ ID NO: 534 - DNA, 9 bp, Artificial Sequence
  Synthetic nucleic acid molecule
gagtgaggg

SEQ ID NO: 535 - DNA, 9 bp, Artificial Sequence
  Synthetic nucleic acid molecule
gagtgaggg

SEQ ID NO: 536 - DNA, 9 bp, Artificial Sequence
  Synthetic nucleic acid molecule
gagtgaggg

SEQ ID NO: 537 - DNA, 9 bp, Artificial Sequence
  Synthetic nucleic acid molecule
gagtgaggg

SEQ ID NO: 538 - DNA, 9 bp, Artificial Sequence
  Synthetic nucleic acid molecule
gagtgaggc

SEQ ID NO: 539 - DNA, 9 bp, Artificial Sequence
  Synthetic nucleic acid molecule
gagtgaggc

SEQ ID NO: 540 - DNA, 9 bp, Artificial Sequence
  Synthetic nucleic acid molecule
gagtgaggc

SEQ ID NO: 541 - DNA, 9 bp, Artificial Sequence
  Synthetic nucleic acid molecule
gagtgaggg

SEQ ID NO: 542 - DNA, 9 bp, Artificial Sequence
  Synthetic nucleic acid molecule
gagtgaggg

SEQ ID NO: 543 - DNA, 9 bp, Artificial Sequence
  Synthetic nucleic acid molecule
gagtgaggt

SEQ ID NO: 544 - DNA, 9 bp, Artificial Sequence
  Synthetic nucleic acid molecule
gagtgaggc

SEQ ID NO: 545 - DNA, 9 bp, Artificial Sequence
  Synthetic nucleic acid molecule
gagtgaggc

SEQ ID NO: 546 - DNA, 9 bp, Artificial Sequence
  Synthetic nucleic acid molecule
gagtgaggg

SEQ ID NO: 547 - DNA, 9 bp, Artificial Sequence
  Synthetic nucleic acid molecule
gagtgaggt

SEQ ID NO: 548 - DNA, 9 bp, Artificial Sequence
  Synthetic nucleic acid molecule
gagtgaggg

SEQ ID NO: 549 - DNA, 9 bp, Artificial Sequence
  Synthetic nucleic acid molecule
gagtgaggt

SEQ ID NO: 550 - DNA, 9 bp, Artificial Sequence
  Synthetic nucleic acid molecule
gagtgaggc

SEQ ID NO: 551 - DNA, 9 bp, Artificial Sequence
  Synthetic nucleic acid molecule
gagtgaggc

SEQ ID NO: 552 - DNA, 9 bp, Artificial Sequence
  Synthetic nucleic acid molecule
gagtgaggc

SEQ ID NO: 553 - DNA, 9 bp, Artificial Sequence
  Synthetic nucleic acid molecule
gagtgaggt

SEQ ID NO: 554 - DNA, 9 bp, Artificial Sequence
  Synthetic nucleic acid molecule
gagtgaggc

SEQ ID NO: 555 - DNA, 9 bp, Artificial Sequence
  Synthetic nucleic acid molecule
gagtgagga

SEQ ID NO: 556 - DNA, 9 bp, Artificial Sequence
  Synthetic nucleic acid molecule
gagtgagga

SEQ ID NO: 557 - DNA, 9 bp, Artificial Sequence
  Synthetic nucleic acid molecule
gagtgaggt

SEQ ID NO: 558 - DNA, 23 bp, Artificial Sequence
  Synthetic nucleic acid molecule
agcagcgtcttcgagagtgagga

SEQ ID NO: 559 - DNA, 23 bp, Artificial Sequence
  Synthetic nucleic acid molecule
agcagcgtcaatacgagtgaaga

SEQ ID NO: 560 - DNA, 23 bp, Artificial Sequence
  Synthetic nucleic acid molecule
agcagcctctgcttgagtgagga

SEQ ID NO: 561 - DNA, 23 bp, Artificial Sequence
  Synthetic nucleic acid molecule
agcagcgttgggaggagtgagga

SEQ ID NO: 562 - DNA, 23 bp, Artificial Sequence
  Synthetic nucleic acid molecule
agcagcgtcaaaaacagtgagca

SEQ ID NO: 563 - DNA, 23 bp, Artificial Sequence
  Synthetic nucleic acid molecule
agcagcgtcgtgtggtgtgaggt

SEQ ID NO: 564 - DNA, 24 bp, Artificial Sequence
  Synthetic nucleic acid molecule
agcagcgtcgttctcaagtgggga

SEQ ID NO: 565 - DNA, 24 bp, Artificial Sequence
  Synthetic nucleic acid molecule
agcagcgtctaggcagagggaaga

SEQ ID NO: 566 - DNA, 24 bp, Artificial Sequence
  Synthetic nucleic acid molecule
agcagcgtctagggggagggaggg

SEQ ID NO: 567 - DNA, 24 bp, Artificial Sequence
  Synthetic nucleic acid molecule
agcagcgtctcaaaagagtgtgca

SEQ ID NO: 568 - DNA, 24 bp, Artificial Sequence
  Synthetic nucleic acid molecule
agcagcgtctcccttgagtgatgg

SEQ ID NO: 569 - DNA, 23 bp, Artificial Sequence
  Synthetic nucleic acid molecule
agcagcgtctgaaagagtgaaaa

SEQ ID NO: 570 - DNA, 23 bp, Artificial Sequence
  Synthetic nucleic acid molecule
agaagcgtcatcgagagtgaggt

SEQ ID NO: 571 - DNA, 24 bp, Artificial Sequence
  Synthetic nucleic acid molecule
agcaacgtcagataggggtgagga

SEQ ID NO: 572 - DNA, 23 bp, Artificial Sequence
  Synthetic nucleic acid molecule
agcaacgtcatattcagtgagga

SEQ ID NO: 573 - DNA, 23 bp, Artificial Sequence
  Synthetic nucleic acid molecule
agcaacgtcgtagtgattgagga

SEQ ID NO: 574 - DNA, 23 bp, Artificial Sequence
  Synthetic nucleic acid molecule
agcaccgtcttttctagtgagga

SEQ ID NO: 575 - DNA, 24 bp, Artificial Sequence
  Synthetic nucleic acid molecule
agcagagtcagacttgagtgaggt

SEQ ID NO: 576 - DNA, 23 bp, Artificial Sequence
  Synthetic nucleic acid molecule
agcagagtctctgagagtgaggc

SEQ ID NO: 577 - DNA, 23 bp, Artificial Sequence
  Synthetic nucleic acid molecule
agcagcatcagtgagagtgaggc

SEQ ID NO: 578 - DNA, 24 bp, Artificial Sequence
  Synthetic nucleic acid molecule
agcagcctctccaaagagtgaggc

SEQ ID NO: 579 - DNA, 24 bp, Artificial Sequence
  Synthetic nucleic acid molecule
agcagcctctgcatcgagtgaggt

SEQ ID NO: 580 - DNA, 24 bp, Artificial Sequence
  Synthetic nucleic acid molecule
agcagcgacgcctgggagtgaggt

SEQ ID NO: 581 - DNA, 23 bp, Artificial Sequence
  Synthetic nucleic acid molecule
agcagcgtgcccaagagtgaggc

SEQ ID NO: 582 - DNA, 24 bp, Artificial Sequence
  Synthetic nucleic acid molecule
agcagcttcaggggagtgtgagga

SEQ ID NO: 583 - DNA, 23 bp, Artificial Sequence
  Synthetic nucleic acid molecule
agcagcttccttttgagtgagaa

SEQ ID NO: 584 - DNA, 24 bp, Artificial Sequence
  Synthetic nucleic acid molecule
agcagcttctcctgggagtgaggg

SEQ ID NO: 585 - DNA, 24 bp, Artificial Sequence
  Synthetic nucleic acid molecule
agcagggtcagggctgagtgaggc

SEQ ID NO: 586 - DNA, 24 bp, Artificial Sequence
  Synthetic nucleic acid molecule
agcagtgtcaggctggtgtgagga

SEQ ID NO: 587 - DNA, 24 bp, Artificial Sequence
  Synthetic nucleic acid molecule
agcagtgtcaggctggtgtgagga

SEQ ID NO: 588 - DNA, 24 bp, Artificial Sequence
  Synthetic nucleic acid molecule
agcagtgtcaggctggtgtgagga

SEQ ID NO: 589 - DNA, 24 bp, Artificial Sequence
  Synthetic nucleic acid molecule
agcagtgtcaggctggtgtgagga

SEQ ID NO: 590 - DNA, 24 bp, Artificial Sequence
  Synthetic nucleic acid molecule
agcagtgtcaggctggtgtgagga

SEQ ID NO: 591 - DNA, 24 bp, Artificial Sequence
  Synthetic nucleic acid molecule
agcagtgtcctaagggggtgagga

SEQ ID NO: 592 - DNA, 24 bp, Artificial Sequence
  Synthetic nucleic acid molecule
agcatcgtcatcagacagtgagga

SEQ ID NO: 593 - DNA, 24 bp, Artificial Sequence
  Synthetic nucleic acid molecule
agcatcgtctgaagtgagtgaggc

SEQ ID NO: 594 - DNA, 24 bp, Artificial Sequence
  Synthetic nucleic acid molecule
agcatcgtcttctgtgagtgagta

SEQ ID NO: 595 - DNA, 24 bp, Artificial Sequence
  Synthetic nucleic acid molecule
aggagcgtctcacctgagtgaggc

SEQ ID NO: 596 - DNA, 24 bp, Artificial Sequence
  Synthetic nucleic acid molecule
aacagcttcatctcggagtgagga

SEQ ID NO: 597 - DNA, 24 bp, Artificial Sequence
  Synthetic nucleic acid molecule
aacagcttctcgggagagtgagga

SEQ ID NO: 598 - DNA, 24 bp, Artificial Sequence
  Synthetic nucleic acid molecule
aacagcttctctgaggagtgagga

SEQ ID NO: 599 - DNA, 23 bp, Artificial Sequence
  Synthetic nucleic acid molecule
agcaaagtcaaacagagtgagga

SEQ ID NO: 600 - DNA, 24 bp, Artificial Sequence
  Synthetic nucleic acid molecule
agcaacttctggaaagagtgagga

SEQ ID NO: 601 - DNA, 23 bp, Artificial Sequence
  Synthetic nucleic acid molecule
agcaccttcaattggagtgagga

SEQ ID NO: 602 - DNA, 24 bp, Artificial Sequence
  Synthetic nucleic acid molecule
agcagcataatagcagagtgagga

SEQ ID NO: 603 - DNA, 24 bp, Artificial Sequence
  Synthetic nucleic acid molecule
agcagcatagatatggagtgagga

SEQ ID NO: 604 - DNA, 23 bp, Artificial Sequence
  Synthetic nucleic acid molecule
agcagcatatcagggagtgagga

SEQ ID NO: 605 - DNA, 23 bp, Artificial Sequence
  Synthetic nucleic acid molecule
agcagcgagaaagagagtgagga

SEQ ID NO: 606 - DNA, 23 bp, Artificial Sequence
  Synthetic nucleic acid molecule
agcagcggtcttaggagtgagga

SEQ ID NO: 607 - DNA, 24 bp, Artificial Sequence
  Synthetic nucleic acid molecule
agcagggttcttcaagagtgagga

SEQ ID NO: 608 - DNA, 23 bp, Artificial Sequence
  Synthetic nucleic acid molecule
agctgagtcctaaagagtgagga

SEQ ID NO: 609 - DNA, 23 bp, Artificial Sequence
  Synthetic nucleic acid molecule
agctgagtcttaaggagtgagga

SEQ ID NO: 610 - DNA, 23 bp, Artificial Sequence
  Synthetic nucleic acid molecule
agctgggtcatgaggagtgagga

SEQ ID NO: 611 - DNA, 23 bp, Artificial Sequence
  Synthetic nucleic acid molecule
agctgggtcatgaggagtgagga

SEQ ID NO: 612 - DNA, 23 bp, Artificial Sequence
  Synthetic nucleic acid molecule
agctgtgtccacaggagtgagga

SEQ ID NO: 613 - DNA, 23 bp, Artificial Sequence
  Synthetic nucleic acid molecule
agctgtgtcttggagagtgagga

SEQ ID NO: 614 - DNA, 23 bp, Artificial Sequence
  Synthetic nucleic acid molecule
agtagcggcaaattgagtgagga

SEQ ID NO: 615 - DNA, 23 bp, Artificial Sequence
  Synthetic nucleic acid molecule
agtggcgtcccagtgagtgagga

SEQ ID NO: 616 - DNA, 23 bp, Artificial Sequence
  Synthetic nucleic acid molecule
ggcagagtcctagagagtgagga

SEQ ID NO: 617 - DNA, 24 bp, Artificial Sequence
  Synthetic nucleic acid molecule
tccagcgtcctcccagagtgagga

SEQ ID NO: 618 - DNA, 24 bp, Artificial Sequence
  Synthetic nucleic acid molecule
tgcagcggcgtaggggagtgagga

SEQ ID NO: 619 - DNA, 24 bp, Artificial Sequence
  Synthetic nucleic acid molecule
tgcagcgttaaaatagagtgagga

SEQ ID NO: 620 - DNA, 24 bp, Artificial Sequence
  Synthetic nucleic acid molecule
tgcagggtcgggcaggagtgagga

SEQ ID NO: 621 - DNA, 23 bp, Artificial Sequence
  Synthetic nucleic acid molecule
tgcagtgtccacaagagtgagga

SEQ ID NO: 622 - DNA, 24 bp, Artificial Sequence
  Synthetic nucleic acid molecule
agcaacgtccatagtgtgtgagaa

SEQ ID NO: 623 - DNA, 24 bp, Artificial Sequence
  Synthetic nucleic acid molecule
agcaacgtctaacccgagtgttga

SEQ ID NO: 624 - DNA, 23 bp, Artificial Sequence
  Synthetic nucleic acid molecule
agcaccgtccccctcagtgaggc

SEQ ID NO: 625 - DNA, 23 bp, Artificial Sequence
  Synthetic nucleic acid molecule
agcagcggcggctgcagtgaggc

SEQ ID NO: 626 - DNA, 24 bp, Artificial Sequence
  Synthetic nucleic acid molecule
agcagcggcttaagggggtgaggt

SEQ ID NO: 627 - DNA, 24 bp, Artificial Sequence
  Synthetic nucleic acid molecule
agcagtgtctaaaaggagtgagat

SEQ ID NO: 628 - DNA, 24 bp, Artificial Sequence
  Synthetic nucleic acid molecule
agaaacgtcgtggaggagtgaggg

SEQ ID NO: 629 - DNA, 24 bp, Artificial Sequence
  Synthetic nucleic acid molecule
agcaaagtctgtactgagtgaggg

SEQ ID NO: 630 - DNA, 23 bp, Artificial Sequence
  Synthetic nucleic acid molecule
agcaacatcatcttgagtgaggg

SEQ ID NO: 631 - DNA, 24 bp, Artificial Sequence
  Synthetic nucleic acid molecule
agcaacatctggttggagtgaggg

SEQ ID NO: 632 - DNA, 23 bp, Artificial Sequence
  Synthetic nucleic acid molecule
agcaacttcatcttgagtgaggg

SEQ ID NO: 633 - DNA, 23 bp, Artificial Sequence
  Synthetic nucleic acid molecule
agcaacttcctggcgagtgaggg

SEQ ID NO: 634 - DNA, 23 bp, Artificial Sequence
  Synthetic nucleic acid molecule
agcaatgtcaaaaagagtgaggc

SEQ ID NO: 635 - DNA, 23 bp, Artificial Sequence
  Synthetic nucleic acid molecule
agcaccgtggcttcgagtgaggc

SEQ ID NO: 636 - DNA, 23 bp, Artificial Sequence
  Synthetic nucleic acid molecule
agcacggtcatgatgagtgaggc

SEQ ID NO: 637 - DNA, 24 bp, Artificial Sequence
  Synthetic nucleic acid molecule
agcagcagcccacaggagtgaggg

SEQ ID NO: 638 - DNA, 23 bp, Artificial Sequence
  Synthetic nucleic acid molecule
agcagcagctaggggagtgaggg

SEQ ID NO: 639 - DNA, 23 bp, Artificial Sequence
  Synthetic nucleic acid molecule
agcagctcctctccgagtgaggt

SEQ ID NO: 640 - DNA, 23 bp, Artificial Sequence
  Synthetic nucleic acid molecule
agcagggtggcgtggagtgaggc

SEQ ID NO: 641 - DNA, 24 bp, Artificial Sequence
  Synthetic nucleic acid molecule
agcatagtctaggccgagtgaggc

SEQ ID NO: 642 - DNA, 23 bp, Artificial Sequence
  Synthetic nucleic acid molecule
agcatggtcccaaggagtgaggg

SEQ ID NO: 643 - DNA, 24 bp, Artificial Sequence
  Synthetic nucleic acid molecule
agcattgtctcatgtgagtgaggt

SEQ ID NO: 644 - DNA, 23 bp, Artificial Sequence
  Synthetic nucleic acid molecule
agcattgtctcctggagtgaggg

SEQ ID NO: 645 - DNA, 23 bp, Artificial Sequence
  Synthetic nucleic acid molecule
agtagcgtttttaggagtgaggt

SEQ ID NO: 646 - DNA, 23 bp, Artificial Sequence
  Synthetic nucleic acid molecule
atcagagtctctgggagtgaggc

SEQ ID NO: 647 - DNA, 24 bp, Artificial Sequence
  Synthetic nucleic acid molecule
atcagtgtccctcaggagtgaggc

SEQ ID NO: 648 - DNA, 24 bp, Artificial Sequence
  Synthetic nucleic acid molecule
ggcagagtcagggctgagtgaggc

SEQ ID NO: 649 - DNA, 24 bp, Artificial Sequence
  Synthetic nucleic acid molecule
ggcagcggccgctgtgagtgaggt

SEQ ID NO: 650 - DNA, 23 bp, Artificial Sequence
  Synthetic nucleic acid molecule
tgcagcttcatggtgagtgaggc

SEQ ID NO: 651 - DNA, 24 bp, Artificial Sequence
  Synthetic nucleic acid molecule
agcatagttacctgggagtgagga

SEQ ID NO: 652 - DNA, 24 bp, Artificial Sequence
  Synthetic nucleic acid molecule
agtaaagtctaagtagagtgagga

SEQ ID NO: 653 - DNA, 23 bp, Artificial Sequence
  Synthetic nucleic acid molecule
tgcagtctccttgggagtgaggt

SEQ ID NO: 654 - DNA, 23 bp, Artificial Sequence
  Synthetic nucleic acid molecule
  misc_feature (1)..(5): n is a, c, g, or t
nnnnncgatcgttgggaaccgga

SEQ ID NO: 655 - DNA, 42 bp, Artificial Sequence
  Synthetic nucleic acid molecule
  misc_feature (1)..(30): n is a, c, g, or t
nnnnnnnnnnnnnnnnnnnnnnnnnnnnnncagtggaacgaa

SEQ ID NO: 656 - DNA, 51 bp, Artificial Sequence
  Synthetic nucleic acid molecule
  misc_feature (1)..(31): n is a, c, g, or t
nnnnnnnnnnnnnnnnnnnnnnnnnnnnnnncagtggaacgaaaactcacg

SEQ ID NO: 657 - DNA, 52 bp, Artificial Sequence
  Synthetic nucleic acid molecule
  misc_feature (1)..(32): n is a, c, g, or t
nnnnnnnnnnnnnnnnnnnnnnnnnnnnnnnncagtggaacgaaaactcacg

SEQ ID NO: 658 - DNA, 53 bp, Artificial Sequence
  Synthetic nucleic acid molecule
  misc_feature (1)..(33): n is a, c, g, or t
nnnnnnnnnnnnnnnnnnnnnnnnnnnnnnnnncagtggaacgaaaactcacg

SEQ ID NO: 659 - DNA, 44 bp, Artificial Sequence
  Synthetic nucleic acid molecule
  misc_feature (1)..(24): n is a, c, g, or t
nnnnnnnnnnnnnnnnnnnnnnnncagtggaacgaaaactcacg

SEQ ID NO: 660 - DNA, 45 bp, Artificial Sequence
  Synthetic nucleic acid molecule
  misc_feature (1)..(25): n is a, c, g, or t
nnnnnnnnnnnnnnnnnnnnnnnnncagtggaacgaaaactcacg

SEQ ID NO: 661 - DNA, 46 bp, Artificial Sequence
  Synthetic nucleic acid molecule
  misc_feature (1)..(26): n is a, c, g, or t
nnnnnnnnnnnnnnnnnnnnnnnnnncagtggaacgaaaactcacg

SEQ ID NO: 662 - DNA, 47 bp, Artificial Sequence
  Synthetic nucleic acid molecule
  misc_feature (1)..(27): n is a, c, g, or t
nnnnnnnnnnnnnnnnnnnnnnnnnnncagtggaacgaaaactcacg

SEQ ID NO: 663 - DNA, 26 bp, Artificial Sequence
  Synthetic nucleic acid molecule
gcgacacggaaatgttgaatactcat

SEQ ID NO: 664 - DNA, 18 bp, Artificial Sequence
  Synthetic nucleic acid molecule
cagcgagtcagtgagcga

SEQ ID NO: 665 - DNA, 34 bp, Artificial Sequence
  Synthetic nucleic acid molecule
acactctttccctacacgacgctcttccgatctt

SEQ ID NO: 666 - DNA, 37 bp, Artificial Sequence
  Synthetic nucleic acid molecule
acactctttccctacacgacgctcttccgatctaatt

SEQ ID NO: 667 - DNA, 37 bp, Artificial Sequence
  Synthetic nucleic acid molecule
acactctttccctacacgacgctcttccgatctatat

SEQ ID NO: 668 - DNA, 37 bp, Artificial Sequence
  Synthetic nucleic acid molecule
acactctttccctacacgacgctcttccgatcttaat

SEQ ID NO: 669 - DNA, 37 bp, Artificial Sequence
  Synthetic nucleic acid molecule
acactctttccctacacgacgctcttccgatctcact

SEQ ID NO: 670 - DNA, 33 bp, Artificial Sequence
  Synthetic nucleic acid molecule
agatcggaagagcggttcagcaggaatgccgag

SEQ ID NO: 671 - DNA, 36 bp, Artificial Sequence
  Synthetic nucleic acid molecule
attagatcggaagagcggttcagcaggaatgccgag

SEQ ID NO: 672 - DNA, 36 bp, Artificial Sequence
  Synthetic nucleic acid molecule
tatagatcggaagagcggttcagcaggaatgccgag

SEQ ID NO: 673 - DNA, 36 bp, Artificial Sequence
  Synthetic nucleic acid molecule
ttaagatcggaagagcggttcagcaggaatgccgag

SEQ ID NO: 674 - DNA, 36 bp, Artificial Sequence
  Synthetic nucleic acid molecule
gtgagatcggaagagcggttcagcaggaatgccgag

SEQ ID NO: 675 - DNA, 60 bp, Artificial Sequence
  Synthetic nucleic acid molecule
caagcagaagacggcatacgagatcggtctcggcattcctgctgaaccgctcttccgatc

SEQ ID NO: 676 - DNA, 58 bp, Artificial Sequence
  Synthetic nucleic acid molecule
aatgatacggcgaccaccgagatctacactctttccctacacgacgctcttccgatct

SEQ ID NO: 677 - DNA, 20 bp, Artificial Sequence
  Synthetic nucleic acid molecule
atacatcggagccctgccaa

SEQ ID NO: 678 - DNA, 20 bp, Artificial Sequence
  Synthetic nucleic acid molecule
tcctgcctccgctctactcg

SEQ ID NO: 679 - DNA, 20 bp, Artificial Sequence
  Synthetic nucleic acid molecule
tcccacgttttccccttgac

SEQ ID NO: 680 - DNA, 23 bp, Artificial Sequence
  Synthetic nucleic acid molecule
gcactgccccagaaatattggtt

SEQ ID NO: 681 - DNA, 20 bp, Artificial Sequence
  Synthetic nucleic acid molecule
atgccacccctgccagataa

SEQ ID NO: 682 - DNA, 20 bp, Artificial Sequence
  Synthetic nucleic acid molecule
tctgcttctgcccttctgga

SEQ ID NO: 683 - DNA, 25 bp, Artificial Sequence
  Synthetic nucleic acid molecule
ccccagtgcttaacatagttcttgg

SEQ ID NO: 684 - DNA, 23 bp, Artificial Sequence
  Synthetic nucleic acid molecule
ggcaccagaacttactcactgcc

SEQ ID NO: 685 - DNA, 20 bp, Artificial Sequence
  Synthetic nucleic acid molecule
gttttgggggtcatggcaaa

SEQ ID NO: 686 - DNA, 21 bp, Artificial Sequence
  Synthetic nucleic acid molecule
tttccctggtgatgcactcct

SEQ ID NO: 687 - DNA, 20 bp, Artificial Sequence
  Synthetic nucleic acid molecule
ttgggggaatgagattggga

SEQ ID NO: 688 - DNA, 20 bp, Artificial Sequence
  Synthetic nucleic acid molecule
ccttcccatggtcacagagg

SEQ ID NO: 689 - DNA, 20 bp, Artificial Sequence
  Synthetic nucleic acid molecule
tcctcccgttgaggaagcac

SEQ ID NO: 690 - DNA, 20 bp, Artificial Sequence
  Synthetic nucleic acid molecule
cagaccgctgctgctgagac

SEQ ID NO: 691 - DNA, 20 bp, Artificial Sequence
  Synthetic nucleic acid molecule
tgggttcctcgggttctctg

SEQ ID NO: 692 - DNA, 20 bp, Artificial Sequence
  Synthetic nucleic acid molecule
aggcataagccactgcaccc

SEQ ID NO: 693 - DNA, 26 bp, Artificial Sequence
  Synthetic nucleic acid molecule
gaggatattttattgctggctcttgc

SEQ ID NO: 694 - DNA, 20 bp, Artificial Sequence
  Synthetic nucleic acid molecule
gctgaggcccacctttcctt

SEQ ID NO: 695 - DNA, 20 bp, Artificial Sequence
  Synthetic nucleic acid molecule
tgttttgggtgcatgtgggt

SEQ ID NO: 696 - DNA, 20 bp, Artificial Sequence
  Synthetic nucleic acid molecule
ctgggtcagctgggccatac

SEQ ID NO: 697 - DNA, 21 bp, Artificial Sequence
  Synthetic nucleic acid molecule
ccagccttggaaaaatggaca

SEQ ID NO: 698 - DNA, 25 bp, Artificial Sequence
  Synthetic nucleic acid molecule
catggatgtaatgggttgtatctgc

SEQ ID NO: 699 - DNA, 20 bp, Artificial Sequence
  Synthetic nucleic acid molecule
aggatgcattgtcccccaga

SEQ ID NO: 700 - DNA, 20 bp, Artificial Sequence
  Synthetic nucleic acid molecule
cgttggcttgcagaagggac

SEQ ID NO: 701 - DNA, 23 bp, Artificial Sequence
  Synthetic nucleic acid molecule
tgacccaactaagtctgtgaccc

SEQ ID NO: 702 - DNA, 24 bp, Artificial Sequence
  Synthetic nucleic acid molecule
tgggttgtgtttttgactgacaga

SEQ ID NO: 703 - DNA, 20 bp, Artificial Sequence
  Synthetic nucleic acid molecule
cacccccatgcaggaaaatg

SEQ ID NO: 704 - DNA, 20 bp, Artificial Sequence
  Synthetic nucleic acid molecule
ggccattggttctggaggaa

SEQ ID NO: 705 - DNA, 20 bp, Artificial Sequence
  Synthetic nucleic acid molecule
agtcagcaatgccccagagc

SEQ ID NO: 706 - DNA, 22 bp, Artificial Sequence
  Synthetic nucleic acid molecule
cctgggagggtgactagttgga

SEQ ID NO: 707 - DNA, 20 bp, Artificial Sequence
  Synthetic nucleic acid molecule
tggcaattaggatgtgccag

SEQ ID NO: 708 - DNA, 20 bp, Artificial Sequence
  Synthetic nucleic acid molecule
tgccccacatcttcaccaga

SEQ ID NO: 709 - DNA, 20 bp, Artificial Sequence
  Synthetic nucleic acid molecule
gttgcatctgcggtcttcca

SEQ ID NO: 710 - DNA, 20 bp, Artificial Sequence
  Synthetic nucleic acid molecule
tagtggccccaacatgcaaa

SEQ ID NO: 711 - DNA, 20 bp, Artificial Sequence
  Synthetic nucleic acid molecule
cctttccaaagcccattccc

SEQ ID NO: 712 - DNA, 20 bp, Artificial Sequence
  Synthetic nucleic acid molecule
ttcactgccttcaggcctcc

SEQ ID NO: 713 - DNA, 20 bp, Artificial Sequence
  Synthetic nucleic acid molecule
cacagggacccaggactgct

SEQ ID NO: 714 - DNA, 20 bp, Artificial Sequence
  Synthetic nucleic acid molecule
gcaccaggcttctctgccat

SEQ ID NO: 715 - DNA, 20 bp, Artificial Sequence
  Synthetic nucleic acid molecule
ccaaggcgaggacattgagg

SEQ ID NO: 716 - DNA, 20 bp, Artificial Sequence
  Synthetic nucleic acid molecule
accatagtccagcggggtca

SEQ ID NO: 717 - DNA, 20 bp, Artificial Sequence
  Synthetic nucleic acid molecule
agaaagggtggtcggggaag

SEQ ID NO: 718 - DNA, 20 bp, Artificial Sequence
  Synthetic nucleic acid molecule
ttcccatggggtctcagctc

SEQ ID NO: 719 - DNA, 20 bp, Artificial Sequence
  Synthetic nucleic acid molecule
cagcaaggatgcccttcacc

SEQ ID NO: 720 - DNA, 20 bp, Artificial Sequence
  Synthetic nucleic acid molecule
ggcttgagctggaaggacca

SEQ ID NO: 721 - DNA, 20 bp, Artificial Sequence
  Synthetic nucleic acid molecule
aaccgagtttgcaccgtcgt

SEQ ID NO: 722 - DNA, 20 bp, Artificial Sequence
  Synthetic nucleic acid molecule
tatcctcccctttcccctga

SEQ ID NO: 723 - DNA, 20 bp, Artificial Sequence
  Synthetic nucleic acid molecule
agaacccggaatccctttgc

SEQ ID NO: 724 - DNA, 20 bp, Artificial Sequence
  Synthetic nucleic acid molecule
ggtctctgccatgcccaact

SEQ ID NO: 725 - DNA, 20 bp, Artificial Sequence
  Synthetic nucleic acid molecule
ccccttgggatccttgtcct

SEQ ID NO: 726 - DNA, 20 bp, Artificial Sequence
  Synthetic nucleic acid molecule
ctaggcctgtgggctgagga

SEQ ID NO: 727 - DNA, 20 bp, Artificial Sequence
  Synthetic nucleic acid molecule
tacctgaaacccctggccct

SEQ ID NO: 728 - DNA, 20 bp, Artificial Sequence
  Synthetic nucleic acid molecule
cgggggcctgacattagtga

SEQ ID NO: 729 - DNA, 21 bp, Artificial Sequence
  Synthetic nucleic acid molecule
tgcattggctcaagaattggg

SEQ ID NO: 730 - DNA, 21 bp, Artificial Sequence
  Synthetic nucleic acid molecule
gcgctccctgtgttcagtacc

SEQ ID NO: 731 - DNA, 20 bp, Artificial Sequence
  Synthetic nucleic acid molecule
tgtttgggttatgggggcag

SEQ ID NO: 732 - DNA, 21 bp, Artificial Sequence
  Synthetic nucleic acid molecule
aaggagacttctcaggcccca

SEQ ID NO: 733 - DNA, 20 bp, Artificial Sequence
  Synthetic nucleic acid molecule
cttgggggcagacagcatct

SEQ ID NO: 734 - DNA, 20 bp, Artificial Sequence
  Synthetic nucleic acid molecule
tggcctcaagcaatcctcct

SEQ ID NO: 735 - DNA, 20 bp, Artificial Sequence
  Synthetic nucleic acid molecule
ccaaagagcctggaggagca

SEQ ID NO: 736 - DNA, 23 bp, Artificial Sequence
  Synthetic nucleic acid molecule
ccagcctgtgaagctggaagtaa

SEQ ID NO: 737 - DNA, 20 bp, Artificial Sequence
  Synthetic nucleic acid molecule
catctgaatgcccatgctgc

SEQ ID NO: 738 - DNA, 21 bp, Artificial Sequence
  Synthetic nucleic acid molecule
cctcaaagaaacggctgctga

SEQ ID NO: 739 - DNA, 20 bp, Artificial Sequence
  Synthetic nucleic acid molecule
cgggctctcctcctcaaaga

SEQ ID NO: 740 - DNA, 20 bp, Artificial Sequence
  Synthetic nucleic acid molecule
ggaatcgcatgacctgaggc

SEQ ID NO: 741 - DNA, 20 bp, Artificial Sequence
  Synthetic nucleic acid molecule
cccgccagacacattcctct

SEQ ID NO: 742 - DNA, 22 bp, Artificial Sequence
  Synthetic nucleic acid molecule
ccgcacctttttcctatgtggt

SEQ ID NO: 743 - DNA, 20 bp, Artificial Sequence
  Synthetic nucleic acid molecule
ggtacatgggccgcactttc

SEQ ID NO: 744 - DNA, 20 bp, Artificial Sequence
  Synthetic nucleic acid molecule
ttacacctgctggcaggcaa

SEQ ID NO: 745 - DNA, 20 bp, Artificial Sequence
  Synthetic nucleic acid molecule
tggccaagcctgcctaactc

SEQ ID NO: 746 - DNA, 20 bp, Artificial Sequence
  Synthetic nucleic acid molecule
ccccttctgctcctgcttca

SEQ ID NO: 747 - DNA, 20 bp, Artificial Sequence
  Synthetic nucleic acid molecule
tgattttcagcgtggagggc

SEQ ID NO: 748 - DNA, 20 bp, Artificial Sequence
  Synthetic nucleic acid molecule
aagctggcagccactcttca

SEQ ID NO: 749 - DNA, 23 bp, Artificial Sequence
  Synthetic nucleic acid molecule
tcgattctccatacaccatcaat

SEQ ID NO: 750 - DNA, 20 bp, Artificial Sequence
  Synthetic nucleic acid molecule
aggtcctggcattgtctggg

SEQ ID NO: 751 - DNA, 20 bp, Artificial Sequence
  Synthetic nucleic acid molecule
ctgggaggcagccagtcaag

SEQ ID NO: 752 - DNA, 21 bp, Artificial Sequence
  Synthetic nucleic acid molecule
caggtgtgcattttgttgcca

SEQ ID NO: 753 - DNA, 20 bp, Artificial Sequence
  Synthetic nucleic acid molecule
tggccctggtcatgtgaaaa

SEQ ID NO: 754 - DNA, 20 bp, Artificial Sequence
  Synthetic nucleic acid molecule
ttgataagggcggtgccact

SEQ ID NO: 755 - DNA, 20 bp, Artificial Sequence
  Synthetic nucleic acid molecule
catccccttgaccaacaggc

SEQ ID NO: 756 - DNA, 20 bp, Artificial Sequence
  Synthetic nucleic acid molecule
actgccaatggaccctctcg

SEQ ID NO: 757 - DNA, 20 bp, Artificial Sequence
  Synthetic nucleic acid molecule
ggggagctagaatggtgggc

SEQ ID NO: 758 - DNA, 20 bp, Artificial Sequence
  Synthetic nucleic acid molecule
cccatgctggtcctgctgtt

SEQ ID NO: 759 - DNA, 20 bp, Artificial Sequence
  Synthetic nucleic acid molecule
ggggtcaccagggaaggttt

SEQ ID NO: 760 - DNA, 20 bp, Artificial Sequence
  Synthetic nucleic acid molecule
tgcccagagaccttccaagc

SEQ ID NO: 761 - DNA, 20 bp, Artificial Sequence
  Synthetic nucleic acid molecule
gccaatgtgcaatcgagacg

SEQ ID NO: 762 - DNA, 20 bp, Artificial Sequence
  Synthetic nucleic acid molecule
tgacttgaactgggtccccc

SEQ ID NO: 763 - DNA, 20 bp, Artificial Sequence
  Synthetic nucleic acid molecule
cccaatccagacaccacacg

SEQ ID NO: 764 - DNA, 20 bp, Artificial Sequence
  Synthetic nucleic acid molecule
ggtgaggaaggatgggggtt

SEQ ID NO: 765 - DNA, 20 bp, Artificial Sequence
  Synthetic nucleic acid molecule
tgcccatgttgttgctccac

SEQ ID NO: 766 - DNA, 20 bp, Artificial Sequence
  Synthetic nucleic acid molecule
tcacagctcccctttctcgg

SEQ ID NO: 767 - DNA, 20 bp, Artificial Sequence
  Synthetic nucleic acid molecule
cctaggcacagtgggggatg

SEQ ID NO: 768 - DNA, 21 bp, Artificial Sequence
  Synthetic nucleic acid molecule
ccatgagcacaattgccaaaa

SEQ ID NO: 769 - DNA, 20 bp, Artificial Sequence
  Synthetic nucleic acid molecule
ctgccaagaacaggagggga

SEQ ID NO: 770 - DNA, 20 bp, Artificial Sequence
  Synthetic nucleic acid molecule
atcggggcagggctagagtc

SEQ ID NO: 771 - DNA, 20 bp, Artificial Sequence
  Synthetic nucleic acid molecule
gccgttagtgcatttgcctg

SEQ ID NO: 772 - DNA, 20 bp, Artificial Sequence
  Synthetic nucleic acid molecule
gttcctcccagagtggggct

SEQ ID NO: 773 - DNA, 19 bp, Artificial Sequence
  Synthetic nucleic acid molecule
aggcctggcggtaaccttg

SEQ ID NO: 774 - DNA, 22 bp, Artificial Sequence
  Synthetic nucleic acid molecule
gggatcctacaggatgggacaa

SEQ ID NO: 775 - DNA, 21 bp, Artificial Sequence
  Synthetic nucleic acid molecule
gccaccaaatgtccactggtt

SEQ ID NO: 776 - DNA, 20 bp, Artificial Sequence
  Synthetic nucleic acid molecule
gcaccagcctcttcgatggt

SEQ ID NO: 777 - DNA, 21 bp, Artificial Sequence
  Synthetic nucleic acid molecule
aatggggcaaaaggcaagaaa

SEQ ID NO: 778 - DNA, 22 bp, Artificial Sequence
  Synthetic nucleic acid molecule
tggcgagataggctctgctaca

SEQ ID NO: 779 - DNA, 20 bp, Artificial Sequence
  Synthetic nucleic acid molecule
tgtgggcatgagaccacagg

SEQ ID NO: 780 - DNA, 25 bp, Artificial Sequence
  Synthetic nucleic acid molecule
tcctattttcagatgcactcgaacc

SEQ ID NO: 781 - DNA, 23 bp, Artificial Sequence
  Synthetic nucleic acid molecule
ggaccttcttgccctcatgattc

SEQ ID NO: 782 - DNA, 21 bp, Artificial Sequence
  Synthetic nucleic acid molecule
ccttgcaaaggcttgcctaaa

SEQ ID NO: 783 - DNA, 20 bp, Artificial Sequence
  Synthetic nucleic acid molecule
tggcttgcagaggaggtgag

SEQ ID NO: 784 - DNA, 20 bp, Artificial Sequence
  Synthetic nucleic acid molecule
gcttcagcacatcagtggcg

SEQ ID NO: 785 - DNA, 21 bp, Artificial Sequence
  Synthetic nucleic acid molecule
ggtgaggccactgtaagccaa

SEQ ID NO: 786 - DNA, 20 bp, Artificial Sequence
  Synthetic nucleic acid molecule
gagttgagctgtcagcgggg

SEQ ID NO: 787 - DNA, 22 bp, Artificial Sequence
  Synthetic nucleic acid molecule
tgttttctgcagttttgcaggg

SEQ ID NO: 788 - DNA, 20 bp, Artificial Sequence
  Synthetic nucleic acid molecule
gctctggcaccaggcacact

SEQ ID NO: 789 - DNA, 20 bp, Artificial Sequence
  Synthetic nucleic acid molecule
gccaaaccctttccagggag

SEQ ID NO: 790 - DNA, 20 bp, Artificial Sequence
  Synthetic nucleic acid molecule
cctcagccagttggaatcgg

SEQ ID NO: 791 - DNA, 20 bp, Artificial Sequence
  Synthetic nucleic acid molecule
tgggtggtgaaaatggggtt

SEQ ID NO: 792 - DNA, 25 bp, Artificial Sequence
  Synthetic nucleic acid molecule
ggaatgtgtggaactcaatttcttt

SEQ ID NO: 793 - DNA, 20 bp, Artificial Sequence
  Synthetic nucleic acid molecule
ccacaagggtcatctgggga

SEQ ID NO: 794 - DNA, 20 bp, Artificial Sequence
  Synthetic nucleic acid molecule
cctggagtggtttggcttcg

SEQ ID NO: 795 - DNA, 20 bp, Artificial Sequence
  Synthetic nucleic acid molecule
ggctcctggggtcattttcc

SEQ ID NO: 796 - DNA, 20 bp, Artificial Sequence
  Synthetic nucleic acid molecule
gtgtgtttccgcacaccctg

SEQ ID NO: 797 - DNA, 20 bp, Artificial Sequence
  Synthetic nucleic acid molecule
ccatcgccgtgtctgagtgt

SEQ ID NO: 798 - DNA, 20 bp, Artificial Sequence
  Synthetic nucleic acid molecule
aggcaatggcaccaaaatgg

SEQ ID NO: 799 - DNA, 23 bp, Artificial Sequence
  Synthetic nucleic acid molecule
ttttgactttgagaaccccctga

SEQ ID NO: 800 - DNA, 21 bp, Artificial Sequence
  Synthetic nucleic acid molecule
gctgagtgcaaagctcaggga

SEQ ID NO: 801 - DNA, 22 bp, Artificial Sequence
  Synthetic nucleic acid molecule
ggaaaaacaggtcagagatggc

SEQ ID NO: 802 - DNA, 20 bp, Artificial Sequence
  Synthetic nucleic acid molecule
accccaaaggtgaccgtcct

SEQ ID NO: 803 - DNA, 20 bp, Artificial Sequence
  Synthetic nucleic acid molecule
gtccctcacgacgaccgact

SEQ ID NO: 804 - DNA, 20 bp, Artificial Sequence
  Synthetic nucleic acid molecule
tggtttgttgggggatcagg

SEQ ID NO: 805 - DNA, 21 bp, Artificial Sequence
  Synthetic nucleic acid molecule
gcctacctcaatgcaggcaaa

SEQ ID NO: 806 - DNA, 20 bp, Artificial Sequence
  Synthetic nucleic acid molecule
ggaggatcgccaagacctga

SEQ ID NO: 807 - DNA, 20 bp, Artificial Sequence
  Synthetic nucleic acid molecule
actcccagacaaaccccgct

SEQ ID NO: 808 - DNA, 20 bp, Artificial Sequence
  Synthetic nucleic acid molecule
tgtgaaggcccaaaaccctg

SEQ ID NO: 809 - DNA, 20 bp, Artificial Sequence
  Synthetic nucleic acid molecule
tgggcagccctaggtccttt

SEQ ID NO: 810 - DNA, 22 bp, Artificial Sequence
  Synthetic nucleic acid molecule
tgatgagtaacttgggcgaaaa

SEQ ID NO: 811 - DNA, 21 bp, Artificial Sequence
  Synthetic nucleic acid molecule
ggaaaatccagcaaggtgaaa

SEQ ID NO: 812 - DNA, 24 bp, Artificial Sequence
  Synthetic nucleic acid molecule
caactctctaacagcaaagtggca

SEQ ID NO: 813 - DNA, 21 bp, Artificial Sequence
  Synthetic nucleic acid molecule
gcctcaaaagcataaacagca

SEQ ID NO: 814 - DNA, 20 bp, Artificial Sequence
  Synthetic nucleic acid molecule
agggcggactcattgctttg

SEQ ID NO: 815 - DNA, 26 bp, Artificial Sequence
  Synthetic nucleic acid molecule
gaaaccagaagttcacaacaatgctt

SEQ ID NO: 816 - DNA, 21 bp, Artificial Sequence
  Synthetic nucleic acid molecule
tggcaatgcctaatcagacca

SEQ ID NO: 817 - DNA, 21 bp, Artificial Sequence
  Synthetic nucleic acid molecule
gagtttggggaaaagccactt

SEQ ID NO: 818 - DNA, 20 bp, Artificial Sequence
  Synthetic nucleic acid molecule
tgctctgccaactgtgaggg

SEQ ID NO: 819 - DNA, 22 bp, Artificial Sequence
  Synthetic nucleic acid molecule
tccagggagtgaggtgaagaca

SEQ ID NO: 820 - DNA, 20 bp, Artificial Sequence
  Synthetic nucleic acid molecule
tcacatctccgcctcacgat

SEQ ID NO: 821 - DNA, 20 bp, Artificial Sequence
  Synthetic nucleic acid molecule
ctgacacagtggccagcagc

SEQ ID NO: 822 - DNA, 20 bp, Artificial Sequence
  Synthetic nucleic acid molecule
gagggcagaagggggtgagt

SEQ ID NO: 823 - DNA, 22 bp, Artificial Sequence
  Synthetic nucleic acid molecule
tggagtgacatgtatgaagcca

SEQ ID NO: 824 - DNA, 21 bp, Artificial Sequence
  Synthetic nucleic acid molecule
tgaaccccggatttttcaacc

SEQ ID NO: 825 - DNA, 21 bp, Artificial Sequence
  Synthetic nucleic acid molecule
ttgggaaagctttgatgctgg

SEQ ID NO: 826 - DNA, 20 bp, Artificial Sequence
  Synthetic nucleic acid molecule
ccctaggggtcactggagca

SEQ ID NO: 827 - DNA, 20 bp, Artificial Sequence
  Synthetic nucleic acid molecule
ttggctgctggcatttggta

SEQ ID NO: 828 - DNA, 21 bp, Artificial Sequence
  Synthetic nucleic acid molecule
tccgttgcttcatccttccaa

SEQ ID NO: 829 - DNA, 23 bp, Artificial Sequence
  Synthetic nucleic acid molecule
tggagagggtttactttcccaga

SEQ ID NO: 830 - DNA, 20 bp, Artificial Sequence
  Synthetic nucleic acid molecule
gctcagggcctggcttacag

SEQ ID NO: 831 - DNA, 25 bp, Artificial Sequence
  Synthetic nucleic acid molecule
tccactcacaaatttacctttccac

SEQ ID NO: 832 - DNA, 20 bp, Artificial Sequence
  Synthetic nucleic acid molecule
ccgcataaaggaggtgtcgg

SEQ ID NO: 833 - DNA, 21 bp, Artificial Sequence
  Synthetic nucleic acid molecule
ggagagtcttccgcctgtgtt

SEQ ID NO: 834 - DNA, 26 bp, Artificial Sequence
  Synthetic nucleic acid molecule
gcacatatcatgcactgtgactgtaa

SEQ ID NO: 835 - DNA, 19 bp, Artificial Sequence
  Synthetic nucleic acid molecule
caaccccacacgcacacac

SEQ ID NO: 836 - DNA, 21 bp, Artificial Sequence
  Synthetic nucleic acid molecule
aatggccagaaaattcccaaa

SEQ ID NO: 837 - DNA, 20 bp, Artificial Sequence
  Synthetic nucleic acid molecule
tgactggaaccgtgcagcat

SEQ ID NO: 838 - DNA, 20 bp, Artificial Sequence
  Synthetic nucleic acid molecule
tcgggggtccatggtatttg

SEQ ID NO: 839 - DNA, 20 bp, Artificial Sequence
  Synthetic nucleic acid molecule
ccccaagtcagaccctgcat

SEQ ID NO: 840 - DNA, 20 bp, Artificial Sequence
  Synthetic nucleic acid molecule
ttctccccaaggaaggctga

SEQ ID NO: 841 - DNA, 20 bp, Artificial Sequence
  Synthetic nucleic acid molecule
gccaccatgcccagtctaca

SEQ ID NO: 842 - DNA, 20 bp, Artificial Sequence
  Synthetic nucleic acid molecule
atggccttccccaactgtga

SEQ ID NO: 843 - DNA, 22 bp, Artificial Sequence
  Synthetic nucleic acid molecule
cgttgtgattgaggagacgagg

SEQ ID NO: 844 - DNA, 22 bp, Artificial Sequence
  Synthetic nucleic acid molecule
tggagcaactgaacatcttggg

SEQ ID NO: 845 - DNA, 21 bp, Artificial Sequence
  Synthetic nucleic acid molecule
cataaccaccaggacatccgc

SEQ ID NO: 846 - DNA, 23 bp, Artificial Sequence
  Synthetic nucleic acid molecule
tgttgccagaagtatcaggtccc

SEQ ID NO: 847 - DNA, 20 bp, Artificial Sequence
  Synthetic nucleic acid molecule
gcagagaaggcagcagcaca

SEQ ID NO: 848 - DNA, 21 bp, Artificial Sequence
  Synthetic nucleic acid molecule
tggaggaagcaggaaaggcat

SEQ ID NO: 849 - DNA, 20 bp, Artificial Sequence
  Synthetic nucleic acid molecule
tcaacaggcagctacagggc

SEQ ID NO: 850 - DNA, 20 bp, Artificial Sequence
  Synthetic nucleic acid molecule
caaatgttggggtgtgggtg

SEQ ID NO: 851 - DNA, 22 bp, Artificial Sequence
  Synthetic nucleic acid molecule
caagctggatgtggatgcagag

SEQ ID NO: 852 - DNA, 20 bp, Artificial Sequence
  Synthetic nucleic acid molecule
gcctgaagatgcatttgccc

SEQ ID NO: 853 - DNA, 24 bp, Artificial Sequence
  Synthetic nucleic acid molecule
tcacacagtggtaatggacaggaa

SEQ ID NO: 854 - DNA, 20 bp, Artificial Sequence
  Synthetic nucleic acid molecule
gcgcaagttcccctttctga

SEQ ID NO: 855 - DNA, 20 bp, Artificial Sequence
  Synthetic nucleic acid molecule
tccagcatctgctcctggtg

SEQ ID NO: 856 - DNA, 20 bp, Artificial Sequence
  Synthetic nucleic acid molecule
tgaagggaagccacagctcc

SEQ ID NO: 857 - DNA, 20 bp, Artificial Sequence
  Synthetic nucleic acid molecule
gccatgggatggcagttagg

SEQ ID NO: 858 - DNA, 20 bp, Artificial Sequence
  Synthetic nucleic acid molecule
ttccatggcagtgaagggtg

SEQ ID NO: 859 - DNA, 20 bp, Artificial Sequence
  Synthetic nucleic acid molecule
cagagggtgtggtggtgtcg

SEQ ID NO: 860 - DNA, 20 bp, Artificial Sequence
  Synthetic nucleic acid molecule
ccagtgggctgagtggatga

SEQ ID NO: 861 - DNA, 18 bp, Artificial Sequence
  Synthetic nucleic acid molecule
ccgccacacccattcctc

SEQ ID NO: 862 - DNA, 20 bp, Artificial Sequence
  Synthetic nucleic acid molecule
gccgctcgaaaagagggaat

SEQ ID NO: 863 - DNA, 20 bp, Artificial Sequence
  Synthetic nucleic acid molecule
ggccccttgaaaagagggaa

SEQ ID NO: 864 - DNA, 20 bp, Artificial Sequence
  Synthetic nucleic acid molecule
cgggctctcctcctcaaaga

SEQ ID NO: 865 - DNA, 20 bp, Artificial Sequence
  Synthetic nucleic acid molecule
catctgaatgcccatgctgc

SEQ ID NO: 866 - DNA, 25 bp, Artificial Sequence
  Synthetic nucleic acid molecule
tcagatgtgctaggacacagatgac

SEQ ID NO: 867 - DNA, 20 bp, Artificial Sequence
  Synthetic nucleic acid molecule
ggacagctgggaattggtgg

SEQ ID NO: 868 - DNA, 20 bp, Artificial Sequence
  Synthetic nucleic acid molecule
gctggtgtgagcaagaggca

SEQ ID NO: 869 - DNA, 20 bp, Artificial Sequence
  Synthetic nucleic acid molecule
tgatcagttagccctggggg

SEQ ID NO: 870 - DNA, 21 bp, Artificial Sequence
  Synthetic nucleic acid molecule
ccttccttgcagctcaaaccc

SEQ ID NO: 871 - DNA, 20 bp, Artificial Sequence
  Synthetic nucleic acid molecule
acggcaaagccagagcaaag

SEQ ID NO: 872 - DNA, 20 bp, Artificial Sequence
  Synthetic nucleic acid molecule
tctcagggcttctgtgtgcg

SEQ ID NO: 873 - DNA, 20 bp, Artificial Sequence
  Synthetic nucleic acid molecule
gcaaccaactcccaacaggg

SEQ ID NO: 874 - DNA, 20 bp, Artificial Sequence
  Synthetic nucleic acid molecule
tggttgcctgtttcacaccc

SEQ ID NO: 875 - DNA, 21 bp, Artificial Sequence
  Synthetic nucleic acid molecule
gccctgtaagctgaagctgga

SEQ ID NO: 876 - DNA, 22 bp, Artificial Sequence
  Synthetic nucleic acid molecule
gcctgccaggtatttcctgtgt

SEQ ID NO: 877 - DNA, 20 bp, Artificial Sequence
  Synthetic nucleic acid molecule
aactgcaagtggcctcccag

SEQ ID NO: 878 - DNA, 20 bp, Artificial Sequence
  Synthetic nucleic acid molecule
tagagggaggtgcttgccca

SEQ ID NO: 879 - DNA, 20 bp, Artificial Sequence
  Synthetic nucleic acid molecule
gcttgggcactgatcctgct

SEQ ID NO: 880 - DNA, 20 bp, Artificial Sequence
  Synthetic nucleic acid molecule
gagttgcccaggtcagccat

SEQ ID NO: 881 - DNA, 21 bp, Artificial Sequence
  Synthetic nucleic acid molecule
caaggtacacagctgcccagg

SEQ ID NO: 882 - DNA, 20 bp, Artificial Sequence
  Synthetic nucleic acid molecule
ggaggctcagcggagaggat

SEQ ID NO: 883 - DNA, 20 bp, Artificial Sequence
  Synthetic nucleic acid molecule
agttgcggggaggtgctaca

SEQ ID NO: 884 - DNA, 20 bp, Artificial Sequence
  Synthetic nucleic acid molecule
tggccaaggcctctctaagc

SEQ ID NO: 885 - DNA, 21 bp, Artificial Sequence
  Synthetic nucleic acid molecule
tgcatgcctctgactgatgct

SEQ ID NO: 886 - DNA, 20 bp, Artificial Sequence
  Synthetic nucleic acid molecule
ctggggctacagccctcctt

SEQ ID NO: 887 - DNA, 21 bp, Artificial Sequence
  Synthetic nucleic acid molecule
tgcagattttaggggttgcca

SEQ ID NO: 888 - DNA, 20 bp, Artificial Sequence
  Synthetic nucleic acid molecule
gtaggctctgccacgccagt

SEQ ID NO: 889 - DNA, 26 bp, Artificial Sequence
  Synthetic nucleic acid molecule
gacaagttagaccatcctagccctca

SEQ ID NO: 890 - DNA, 20 bp, Artificial Sequence
  Synthetic nucleic acid molecule
tgtgcctccactgacgcatt

SEQ ID NO: 891 - DNA, 20 bp, Artificial Sequence
  Synthetic nucleic acid molecule
gggctgacacactgagggct

SEQ ID NO: 892 - DNA, 27 bp, Artificial Sequence
  Synthetic nucleic acid molecule
tgagttatttcgaaagaggaaacagtg

SEQ ID NO: 893 - DNA, 20 bp, Artificial Sequence
  Synthetic nucleic acid molecule
agcccatctaccatccagcg

SEQ ID NO: 894 - DNA, 20 bp, Artificial Sequence
  Synthetic nucleic acid molecule
cccctggcattccctacaca

SEQ ID NO: 895 - DNA, 22 bp, Artificial Sequence
  Synthetic nucleic acid molecule
tccctttcaacccctgtagtgc

SEQ ID NO: 896 - DNA, 20 bp, Artificial Sequence
  Synthetic nucleic acid molecule
actgagggaggcagcactgg

SEQ ID NO: 897 - DNA, 20 bp, Artificial Sequence
  Synthetic nucleic acid molecule
aagctccagccctgtacccc

SEQ ID NO: 898 - DNA, 20 bp, Artificial Sequence
  Synthetic nucleic acid molecule
cagcccaggacaagggtagc

SEQ ID NO: 899 - DNA, 20 bp, Artificial Sequence
  Synthetic nucleic acid molecule
ttccccaagcagtccagctc

SEQ ID NO: 900 - DNA, 20 bp, Artificial Sequence
  Synthetic nucleic acid molecule
cctttggcagactgtggcct

SEQ ID NO: 901 - DNA, 20 bp, Artificial Sequence
  Synthetic nucleic acid molecule
cagacctcgtggtgcatgtg

SEQ ID NO: 902 - DNA, 24 bp, Artificial Sequence
  Synthetic nucleic acid molecule
tggacagggaattactcagaccag

SEQ ID NO: 903 - DNA, 20 bp, Artificial Sequence
  Synthetic nucleic acid molecule
tttgactcccccgcattgtt

SEQ ID NO: 904 - DNA, 20 bp, Artificial Sequence
  Synthetic nucleic acid molecule
gtgctcactgaagcccacca

SEQ ID NO: 905 - DNA, 20 bp, Artificial Sequence
  Synthetic nucleic acid molecule
gggaactgtgcctttgcgtc

SEQ ID NO: 906 - DNA, 20 bp, Artificial Sequence
  Synthetic nucleic acid molecule
ggcaggcacctgtagtccca

SEQ ID NO: 907 - DNA, 20 bp, Artificial Sequence
  Synthetic nucleic acid molecule
cagggaagggtgttggcttg

SEQ ID NO: 908 - DNA, 20 bp, Artificial Sequence
  Synthetic nucleic acid molecule
ttcgcccagctcatcaacaa

SEQ ID NO: 909 - DNA, 20 bp, Artificial Sequence
  Synthetic nucleic acid molecule
tgggctgccatgacaaacag

SEQ ID NO: 910 - DNA, 21 bp, Artificial Sequence
  Synthetic nucleic acid molecule
gaagccaactgccttgtgagc

SEQ ID NO: 911 - DNA, 20 bp, Artificial Sequence
  Synthetic nucleic acid molecule
ggctcagggagtttgagcca

SEQ ID NO: 912 - DNA, 23 bp, Artificial Sequence
  Synthetic nucleic acid molecule
gggagagaaccatgaatttccca

SEQ ID NO: 913 - DNA, 20 bp, Artificial Sequence
  Synthetic nucleic acid molecule
cccaccctatgcacagagcc

SEQ ID NO: 914 - DNA, 25 bp, Artificial Sequence
  Synthetic nucleic acid molecule
caacggtttagtttagttccggttt

SEQ ID NO: 915 - DNA, 20 bp, Artificial Sequence
  Synthetic nucleic acid molecule
ggtggggtatgcactggtca

SEQ ID NO: 916 - DNA, 20 bp, Artificial Sequence
  Synthetic nucleic acid molecule
ttgcttgcagggtgtggaaa

SEQ ID NO: 917 - DNA, 20 bp, Artificial Sequence
  Synthetic nucleic acid molecule
cggaggcatcatccactgag

SEQ ID NO: 918 - DNA, 20 bp, Artificial Sequence
  Synthetic nucleic acid molecule
tggagccctggagttcttgg

SEQ ID NO: 919 - DNA, 20 bp, Artificial Sequence
  Synthetic nucleic acid molecule
tgtgctccatcctcctccct

SEQ ID NO: 920 - DNA, 20 bp, Artificial Sequence
  Synthetic nucleic acid molecule
gctcttggcttcccaaccct

SEQ ID NO: 921 - DNA, 20 bp, Artificial Sequence
  Synthetic nucleic acid molecule
cagcaggaacatcatccccc

SEQ ID NO: 922 - DNA, 22 bp, Artificial Sequence
  Synthetic nucleic acid molecule
gcagccttcaccatacctgtga

SEQ ID NO: 923 - DNA, 25 bp, Artificial Sequence
  Synthetic nucleic acid molecule
ccttgtcctttctcagttagacaca

SEQ ID NO: 924 - DNA, 20 bp, Artificial Sequence
  Synthetic nucleic acid molecule
ggcaacacagcaagacccct

SEQ ID NO: 925 - DNA, 9 bp, Artificial Sequence
  Synthetic nucleic acid molecule
agcagcttc

SEQ ID NO: 926 - DNA, 9 bp, Artificial Sequence
  Synthetic nucleic acid molecule
agcatcgtc

SEQ ID NO: 927 - DNA, 9 bp, Artificial Sequence
  Synthetic nucleic acid molecule
agcaacgtc

SEQ ID NO: 928 - DNA, 9 bp, Artificial Sequence
  Synthetic nucleic acid molecule
agctgggtc

SEQ ID NO: 929 - DNA, 9 bp, Artificial Sequence
  Synthetic nucleic acid molecule
agctgggtc

SEQ ID NO: 930 - DNA, 9 bp, Artificial Sequence
  Synthetic nucleic acid molecule
agcaacttc

SEQ ID NO: 931 - DNA, 9 bp, Artificial Sequence
  Synthetic nucleic acid molecule
agctgagtc

SEQ ID NO: 932 - DNA, 9 bp, Artificial Sequence
  Synthetic nucleic acid molecule
tccagcgtc

SEQ ID NO: 933 - DNA, 9 bp, Artificial Sequence
  Synthetic nucleic acid molecule
tgcagcgtt

SEQ ID NO: 934 - DNA, 9 bp, Artificial Sequence
  Synthetic nucleic acid molecule
agcaccttc

SEQ ID NO: 935 - DNA, 9 bp, Artificial Sequence
  Synthetic nucleic acid molecule
tgcagcggc

SEQ ID NO: 936 - DNA, 9 bp, Artificial Sequence
  Synthetic nucleic acid molecule
agcagggtt

SEQ ID NO: 937 - DNA, 9 bp, Artificial Sequence
  Synthetic nucleic acid molecule
agcagcata

SEQ ID NO: 938 - DNA, 9 bp, Artificial Sequence
  Synthetic nucleic acid molecule
aacagcttc

SEQ ID NO: 939 - DNA, 9 bp, Artificial Sequence
  Synthetic nucleic acid molecule
tgcagggtc

SEQ ID NO: 940 - DNA, 9 bp, Artificial Sequence
  Synthetic nucleic acid molecule
agcaaagtc

SEQ ID NO: 941 - DNA, 9 bp, Artificial Sequence
  Synthetic nucleic acid molecule
aacagcttc

SEQ ID NO: 942 - DNA, 9 bp, Artificial Sequence
  Synthetic nucleic acid molecule
agtagcggc

SEQ ID NO: 943 - DNA, 9 bp, Artificial Sequence
  Synthetic nucleic acid molecule
agctgagtc

SEQ ID NO: 944 - DNA, 9 bp, Artificial Sequence
  Synthetic nucleic acid molecule
agcagcgag

SEQ ID NO: 945 - DNA, 9 bp, Artificial Sequence
  Synthetic nucleic acid molecule
tgcagtgtc

SEQ ID NO: 946 - DNA, 9 bp, Artificial Sequence
  Synthetic nucleic acid molecule
agcagcata

SEQ ID NO: 947 - DNA, 9 bp, Artificial Sequence
  Synthetic nucleic acid molecule
agcagcata

SEQ ID NO: 948 - DNA, 9 bp, Artificial Sequence
  Synthetic nucleic acid molecule
agcagcggt

SEQ ID NO: 949 - DNA, 9 bp, Artificial Sequence
  Synthetic nucleic acid molecule
aacagcttc

SEQ ID NO: 950 - DNA, 9 bp, Artificial Sequence
  Synthetic nucleic acid molecule
ggcagagtc

SEQ ID NO: 951 - DNA, 9 bp, Artificial Sequence
  Synthetic nucleic acid molecule
agctgtgtc

SEQ ID NO: 952 - DNA, 9 bp, Artificial Sequence
  Synthetic nucleic acid molecule
agtggcgtc

SEQ ID NO: 953 - DNA, 9 bp, Artificial Sequence
  Synthetic nucleic acid molecule
agctgtgtc

SEQ ID NO: 954 - DNA, 9 bp, Artificial Sequence
  Synthetic nucleic acid molecule
agcagcggc

SEQ ID NO: 955 - DNA, 9 bp, Artificial Sequence
  Synthetic nucleic acid molecule
agcaacgtc

SEQ ID NO: 956 - DNA, 9 bp, Artificial Sequence
  Synthetic nucleic acid molecule
agcaccgtc

SEQ ID NO: 957 - DNA, 9 bp, Artificial Sequence
  Synthetic nucleic acid molecule
agcagcggc

SEQ ID NO: 958 - DNA, 9 bp, Artificial Sequence
  Synthetic nucleic acid molecule
agcagtgtc

SEQ ID NO: 959 - DNA, 9 bp, Artificial Sequence
  Synthetic nucleic acid molecule
agcaacgtc

SEQ ID NO: 960 - DNA, 9 bp, Artificial Sequence
  Synthetic nucleic acid molecule
agaaacgtc

SEQ ID NO: 961 - DNA, 9 bp, Artificial Sequence
  Synthetic nucleic acid molecule
agcatagtc

SEQ ID NO: 962 - DNA, 9 bp, Artificial Sequence
  Synthetic nucleic acid molecule
agcaacttc

SEQ ID NO: 963 - DNA, 9 bp, Artificial Sequence
  Synthetic nucleic acid molecule
agcagggtg

SEQ ID NO: 964 - DNA, 9 bp, Artificial Sequence
  Synthetic nucleic acid molecule
agcacggtc

SEQ ID NO: 965 - DNA, 9 bp, Artificial Sequence
  Synthetic nucleic acid molecule
agcattgtc

SEQ ID NO: 966 - DNA, 9 bp, Artificial Sequence
  Synthetic nucleic acid molecule
agcaccgtg

SEQ ID NO: 967 - DNA, 9 bp, Artificial Sequence
  Synthetic nucleic acid molecule
agcaacttc

SEQ ID NO: 968 - DNA, 9 bp, Artificial Sequence
  Synthetic nucleic acid molecule
agcaacatc

SEQ ID NO: 969 - DNA, 9 bp, Artificial Sequence
  Synthetic nucleic acid molecule
ggcagcggc

SEQ ID NO: 970 - DNA, 9 bp, Artificial Sequence
  Synthetic nucleic acid molecule
agcattgtc

SEQ ID NO: 971 - DNA, 9 bp, Artificial Sequence
  Synthetic nucleic acid molecule
agcagcagc

SEQ ID NO: 972 - DNA, 9 bp, Artificial Sequence
  Synthetic nucleic acid molecule
agcagcagc

SEQ ID NO: 973 - DNA, 9 bp, Artificial Sequence
  Synthetic nucleic acid molecule
atcagagtc

SEQ ID NO: 974 - DNA, 9 bp, Artificial Sequence
  Synthetic nucleic acid molecule
atcagtgtc

SEQ ID NO: 975 - DNA, 9 bp, Artificial Sequence
  Synthetic nucleic acid molecule
agcaacatc

SEQ ID NO: 976 - DNA, 9 bp, Artificial Sequence
  Synthetic nucleic acid molecule
agcatggtc

SEQ ID NO: 977 - DNA, 9 bp, Artificial Sequence
  Synthetic nucleic acid molecule
agcaaagtc

SEQ ID NO: 978 - DNA, 9 bp, Artificial Sequence
  Synthetic nucleic acid molecule
agcagctcc

SEQ ID NO: 979 - DNA, 9 bp, Artificial Sequence
  Synthetic nucleic acid molecule
agcaatgtc

SEQ ID NO: 980 - DNA, 9 bp, Artificial Sequence
  Synthetic nucleic acid molecule
agtagcgtt

SEQ ID NO: 981 - DNA, 9 bp, Artificial Sequence
  Synthetic nucleic acid molecule
ggcagagtc

SEQ ID NO: 982 - DNA, 9 bp, Artificial Sequence
  Synthetic nucleic acid molecule
tgcagcttc

SEQ ID NO: 983 - DNA, 9 bp, Artificial Sequence
  Synthetic nucleic acid molecule
agcatagtt

SEQ ID NO: 984 - DNA, 9 bp, Artificial Sequence
  Synthetic nucleic acid molecule
agtaaagtc

SEQ ID NO: 985 - DNA, 9 bp, Artificial Sequence
  Synthetic nucleic acid molecule
agcattgtt

SEQ ID NO: 986 - DNA, 9 bp, Artificial Sequence
  Synthetic nucleic acid molecule
tgcagtctc

SEQ ID NO: 987 - DNA, 9 bp, Artificial Sequence
  Synthetic nucleic acid molecule
agcagcgtc

SEQ ID NO: 988 - DNA, 9 bp, Artificial Sequence
  Synthetic nucleic acid molecule
agcagcgtg

SEQ ID NO: 989 - DNA, 9 bp, Artificial Sequence
  Synthetic nucleic acid molecule
agcagcgcc

SEQ ID NO: 990 - DNA, 9 bp, Artificial Sequence
  Synthetic nucleic acid molecule
agcagcggc

SEQ ID NO: 991 - DNA, 9 bp, Artificial Sequence
  Synthetic nucleic acid molecule
agcagcttc

SEQ ID NO: 992 - DNA, 9 bp, Artificial Sequence
  Synthetic nucleic acid molecule
agcagcttc

SEQ ID NO: 993 - DNA, 9 bp, Artificial Sequence
  Synthetic nucleic acid molecule
atcagcgtc

SEQ ID NO: 994 - DNA, 9 bp, Artificial Sequence
  Synthetic nucleic acid molecule
agcagcgtg

SEQ ID NO: 995 - DNA, 9 bp, Artificial Sequence
  Synthetic nucleic acid molecule
agcagggtc

SEQ ID NO: 996 - DNA, 9 bp, Artificial Sequence
  Synthetic nucleic acid molecule
agcagcgtt

SEQ ID NO: 997 - DNA, 9 bp, Artificial Sequence
  Synthetic nucleic acid molecule
agcagcggc

SEQ ID NO: 998 - DNA, 9 bp, Artificial Sequence
  Synthetic nucleic acid molecule
agcagagtc

SEQ ID NO: 999 - DNA, 9 bp, Artificial Sequence
  Synthetic nucleic acid molecule
agcagagtc

SEQ ID NO: 1000 - DNA, 9 bp, Artificial Sequence
  Synthetic nucleic acid molecule
agcagggtc

SEQ ID NO: 1001 - DNA, 9 bp, Artificial Sequence
  Synthetic nucleic acid molecule
agcagcgtg

SEQ ID NO: 1002 - DNA, 9 bp, Artificial Sequence
  Synthetic nucleic acid molecule
agcagcagc

SEQ ID NO: 1003 - DNA, 9 bp, Artificial Sequence
  Synthetic nucleic acid molecule
aggagcttc

SEQ ID NO: 1004 - DNA, 9 bp, Artificial Sequence
  Synthetic nucleic acid molecule
agcagcctg

SEQ ID NO: 1005 - DNA, 9 bp, Artificial Sequence
  Synthetic nucleic acid molecule
accagtgtc

SEQ ID NO: 1006 - DNA, 9 bp, Artificial Sequence
  Synthetic nucleic acid molecule
aacagagtc

SEQ ID NO: 1007 - DNA, 9 bp, Artificial Sequence
  Synthetic nucleic acid molecule
agcagcctg

SEQ ID NO: 1008 - DNA, 9 bp, Artificial Sequence
  Synthetic nucleic acid molecule
agcagcagc

SEQ ID NO: 1009 - DNA, 9 bp, Artificial Sequence
  Synthetic nucleic acid molecule
atcagagtc

SEQ ID NO: 1010 - DNA, 9 bp, Artificial Sequence
  Synthetic nucleic acid molecule
agcggggtc

SEQ ID NO: 1011 - DNA, 9 bp, Artificial Sequence
  Synthetic nucleic acid molecule
agcagcgga

SEQ ID NO: 1012 - DNA, 9 bp, Artificial Sequence
  Synthetic nucleic acid molecule
agcagcgtc

SEQ ID NO: 1013 - DNA, 9 bp, Artificial Sequence
  Synthetic nucleic acid molecule
agcagcgtc

SEQ ID NO: 1014 - DNA, 9 bp, Artificial Sequence
  Synthetic nucleic acid molecule
agcagcgtc

SEQ ID NO: 1015 - DNA, 9 bp, Artificial Sequence
  Synthetic nucleic acid molecule
agcagcgtc

SEQ ID NO: 1016 - DNA, 9 bp, Artificial Sequence
  Synthetic nucleic acid molecule
agcagcgtc

SEQ ID NO: 1017 - DNA, 9 bp, Artificial Sequence
  Synthetic nucleic acid molecule
agcagcgtc

SEQ ID NO: 1018 - DNA, 9 bp, Artificial Sequence
  Synthetic nucleic acid molecule
agcagggtc

SEQ ID NO: 1019 - DNA, 9 bp, Artificial Sequence
  Synthetic nucleic acid molecule
agcagtgtc

SEQ ID NO: 1020 - DNA, 9 bp, Artificial Sequence
  Synthetic nucleic acid molecule
agcagggtc

SEQ ID NO: 1021 - DNA, 9 bp, Artificial Sequence
  Synthetic nucleic acid molecule
agcagggtc

SEQ ID NO: 1022 - DNA, 9 bp, Artificial Sequence
  Synthetic nucleic acid molecule
agcagggtc

SEQ ID NO: 1023 - DNA, 9 bp, Artificial Sequence
  Synthetic nucleic acid molecule
ggcagcgtc

SEQ ID NO: 1024 - DNA, 9 bp, Artificial Sequence
  Synthetic nucleic acid molecule
ggcagcgtc

SEQ ID NO: 1025 - DNA, 9 bp, Artificial Sequence
  Synthetic nucleic acid molecule
agcagggtc

SEQ ID NO: 1026 - DNA, 9 bp, Artificial Sequence
  Synthetic nucleic acid molecule
agcagagtc

SEQ ID NO: 1027 - DNA, 9 bp, Artificial Sequence
  Synthetic nucleic acid molecule
agcagcatc

SEQ ID NO: 1028 - DNA, 9 bp, Artificial Sequence
  Synthetic nucleic acid molecule
agcatcgtc

SEQ ID NO: 1029 - DNA, 9 bp, Artificial Sequence
  Synthetic nucleic acid molecule
agcagtgtc

SEQ ID NO: 1030 - DNA, 9 bp, Artificial Sequence
  Synthetic nucleic acid molecule
ggcagcgtc

SEQ ID NO: 1031 - DNA, 9 bp, Artificial Sequence
  Synthetic nucleic acid molecule
agcagcggc

SEQ ID NO: 1032 - DNA, 9 bp, Artificial Sequence
  Synthetic nucleic acid molecule
agcagcggc

SEQ ID NO: 1033 - DNA, 9 bp, Artificial Sequence
  Synthetic nucleic acid molecule
agcagtgtc

SEQ ID NO: 1034 - DNA, 9 bp, Artificial Sequence
  Synthetic nucleic acid molecule
agcagtgtc

SEQ ID NO: 1035 - DNA, 9 bp, Artificial Sequence
  Synthetic nucleic acid molecule
agcagtgtc

SEQ ID NO: 1036 - DNA, 9 bp, Artificial Sequence
  Synthetic nucleic acid molecule
agcagtgtc

SEQ ID NO: 1037 - DNA, 9 bp, Artificial Sequence
  Synthetic nucleic acid molecule
agcaccgtc

SEQ ID NO: 1038 - DNA, 9 bp, Artificial Sequence
  Synthetic nucleic acid molecule
agccacgtc

SEQ ID NO: 1039 - DNA, 9 bp, Artificial Sequence
  Synthetic nucleic acid molecule
agtagcgcc

SEQ ID NO: 1040 - DNA, 9 bp, Artificial Sequence
  Synthetic nucleic acid molecule
aacagggtc

SEQ ID NO: 1041 - DNA, 9 bp, Artificial Sequence
  Synthetic nucleic acid molecule
ggcagggtc

SEQ ID NO: 1042 - DNA, 9 bp, Artificial Sequence
  Synthetic nucleic acid molecule
aacagggtc

SEQ ID NO: 1043 - DNA, 9 bp, Artificial Sequence
  Synthetic nucleic acid molecule
aggagagtc

SEQ ID NO: 1044 - DNA, 9 bp, Artificial Sequence
  Synthetic nucleic acid molecule
agcagccgc

SEQ ID NO: 1045 - DNA, 9 bp, Artificial Sequence
  Synthetic nucleic acid molecule
ggcagagtc

SEQ ID NO: 1046 - DNA, 9 bp, Artificial Sequence
  Synthetic nucleic acid molecule
agcagtgtg

SEQ ID NO: 1047 - DNA, 9 bp, Artificial Sequence
  Synthetic nucleic acid molecule
agcatcttc

SEQ ID NO: 1048 - DNA, 9 bp, Artificial Sequence
  Synthetic nucleic acid molecule
agcagagtg

SEQ ID NO: 1049 - DNA, 9 bp, Artificial Sequence
  Synthetic nucleic acid molecule
atcagtgtc

SEQ ID NO: 1050 - DNA, 9 bp, Artificial Sequence
  Synthetic nucleic acid molecule
ttcagcgtc

SEQ ID NO: 1051 - DNA, 9 bp, Artificial Sequence
  Synthetic nucleic acid molecule
agcaacttc

SEQ ID NO: 1052 - DNA, 9 bp, Artificial Sequence
  Synthetic nucleic acid molecule
agcagcggg

SEQ ID NO: 1053 - DNA, 9 bp, Artificial Sequence
  Synthetic nucleic acid molecule
agtagcgtg

SEQ ID NO: 1054 - DNA, 9 bp, Artificial Sequence
  Synthetic nucleic acid molecule
agctgcatc

SEQ ID NO: 1055 - DNA, 9 bp, Artificial Sequence
  Synthetic nucleic acid molecule
atcagagtc

SEQ ID NO: 1056 - DNA, 9 bp, Artificial Sequence
  Synthetic nucleic acid molecule
agcaggatc

SEQ ID NO: 1057 - DNA, 9 bp, Artificial Sequence
  Synthetic nucleic acid molecule
agccacgtc

SEQ ID NO: 1058 - DNA, 9 bp, Artificial Sequence
  Synthetic nucleic acid molecule
agcaatgtc

SEQ ID NO: 1059 - DNA, 9 bp, Artificial Sequence
  Synthetic nucleic acid molecule
agcaatgtc

SEQ ID NO: 1060 - DNA, 9 bp, Artificial Sequence
  Synthetic nucleic acid molecule
ggctgcgtc

SEQ ID NO: 1061 - DNA, 9 bp, Artificial Sequence
  Synthetic nucleic acid molecule
ggcagagtc

SEQ ID NO: 1062 - DNA, 9 bp, Artificial Sequence
  Synthetic nucleic acid molecule
agcagtgtg

SEQ ID NO: 1063 - DNA, 9 bp, Artificial Sequence
  Synthetic nucleic acid molecule
ggcaacatc

SEQ ID NO: 1064 - DNA, 9 bp, Artificial Sequence
  Synthetic nucleic acid molecule
cccagcggc

SEQ ID NO: 1065 - DNA, 9 bp, Artificial Sequence
  Synthetic nucleic acid molecule
agcctggtc

SEQ ID NO: 1066 - DNA, 9 bp, Artificial Sequence
  Synthetic nucleic acid molecule
tgcagtctc

SEQ ID NO: 1067 - DNA, 9 bp, Artificial Sequence
  Synthetic nucleic acid molecule
agcattgta

SEQ ID NO: 1068 - DNA, 9 bp, Artificial Sequence
  Synthetic nucleic acid molecule
agcctggtc

SEQ ID NO: 1069 - DNA, 9 bp, Artificial Sequence
  Synthetic nucleic acid molecule
agcatagtg

SEQ ID NO: 1070 - DNA, 9 bp, Artificial Sequence
  Synthetic nucleic acid molecule
agcaaaggc

SEQ ID NO: 1071 - DNA, 9 bp, Artificial Sequence
  Synthetic nucleic acid molecule
aacatggtc

SEQ ID NO: 1072 - DNA, 9 bp, Artificial Sequence
  Synthetic nucleic acid molecule
agctttgtc

SEQ ID NO: 1073 - DNA, 9 bp, Artificial Sequence
  Synthetic nucleic acid molecule
agcaaaggc

SEQ ID NO: 1074 - DNA, 9 bp, Artificial Sequence
  Synthetic nucleic acid molecule
atcaaggtc

SEQ ID NO: 1075 - DNA, 9 bp, Artificial Sequence
  Synthetic nucleic acid molecule
gccagtgtc

SEQ ID NO: 1076 - DNA, 9 bp, Artificial Sequence
  Synthetic nucleic acid molecule
tgcaaagtc

SEQ ID NO: 1077 - DNA, 9 bp, Artificial Sequence
  Synthetic nucleic acid molecule
agcaacgtc

SEQ ID NO: 1078 - DNA, 9 bp, Artificial Sequence
  Synthetic nucleic acid molecule
agcaacgtc

SEQ ID NO: 1079 - DNA, 9 bp, Artificial Sequence
  Synthetic nucleic acid molecule
ggcagtgtc

SEQ ID NO: 1080 - DNA, 9 bp, Artificial Sequence
  Synthetic nucleic acid molecule
agcaaagtc

SEQ ID NO: 1081 - DNA, 9 bp, Artificial Sequence
  Synthetic nucleic acid molecule
tgctgtgtc

SEQ ID NO: 1082 - DNA, 9 bp, Artificial Sequence
  Synthetic nucleic acid molecule
ggcaaggtc

SEQ ID NO: 1083 - DNA, 9 bp, Artificial Sequence
  Synthetic nucleic acid molecule
atcaacgtg

SEQ ID NO: 1084 - DNA, 9 bp, Artificial Sequence
  Synthetic nucleic acid molecule
agcagcgtc

SEQ ID NO: 1085 - DNA, 9 bp, Artificial Sequence
  Synthetic nucleic acid molecule
agcagcgtc

SEQ ID NO: 1086 - DNA, 9 bp, Artificial Sequence
  Synthetic nucleic acid molecule
agcagagtc

SEQ ID NO: 1087 - DNA, 9 bp, Artificial Sequence
  Synthetic nucleic acid molecule
agcagcttc

SEQ ID NO: 1088 - DNA, 9 bp, Artificial Sequence
  Synthetic nucleic acid molecule
ggcagcgtc

SEQ ID NO: 1089 - DNA, 9 bp, Artificial Sequence
  Synthetic nucleic acid molecule
agcagtgtc

SEQ ID NO: 1090 - DNA, 9 bp, Artificial Sequence
  Synthetic nucleic acid molecule
agcagcttc

SEQ ID NO: 1091 - DNA, 9 bp, Artificial Sequence
  Synthetic nucleic acid molecule
agcagctgc

SEQ ID NO: 1092 - DNA, 9 bp, Artificial Sequence
  Synthetic nucleic acid molecule
agcagtggc

SEQ ID NO: 1093 - DNA, 9 bp, Artificial Sequence
  Synthetic nucleic acid molecule
agcagcatg

SEQ ID NO: 1094 - DNA, 9 bp, Artificial Sequence
  Synthetic nucleic acid molecule
agcagcatg

SEQ ID NO: 1095 - DNA, 9 bp, Artificial Sequence
  Synthetic nucleic acid molecule
accagggtc

SEQ ID NO: 1096 - DNA, 9 bp, Artificial Sequence
  Synthetic nucleic acid molecule
agcagcatg

SEQ ID NO: 1097 - DNA, 9 bp, Artificial Sequence
  Synthetic nucleic acid molecule
agcagggtg

SEQ ID NO: 1098 - DNA, 9 bp, Artificial Sequence
  Synthetic nucleic acid molecule
agcagtgac

SEQ ID NO: 1099 - DNA, 9 bp, Artificial Sequence
  Synthetic nucleic acid molecule
agcagattc

SEQ ID NO: 1100 - DNA, 9 bp, Artificial Sequence
  Synthetic nucleic acid molecule
atcagcgtg

SEQ ID NO: 1101 - DNA, 9 bp, Artificial Sequence
  Synthetic nucleic acid molecule
agcaggggc

SEQ ID NO: 1102 - DNA, 9 bp, Artificial Sequence
  Synthetic nucleic acid molecule
agcgccgtc

SEQ ID NO: 1103 - DNA, 9 bp, Artificial Sequence
  Synthetic nucleic acid molecule
agcagcgtc

SEQ ID NO: 1104 - DNA, 9 bp, Artificial Sequence
  Synthetic nucleic acid molecule
agcagcgtc

SEQ ID NO: 1105 - DNA, 9 bp, Artificial Sequence
  Synthetic nucleic acid molecule
agcagcgtc

SEQ ID NO: 1106 - DNA, 9 bp, Artificial Sequence
  Synthetic nucleic acid molecule
agcagcggc

SEQ ID NO: 1107 - DNA, 9 bp, Artificial Sequence
  Synthetic nucleic acid molecule
agcagagtc

SEQ ID NO: 1108 - DNA, 9 bp, Artificial Sequence
  Synthetic nucleic acid molecule
tgcagcgtc

SEQ ID NO: 1109 - DNA, 9 bp, Artificial Sequence
  Synthetic nucleic acid molecule
agcagcgtg

SEQ ID NO: 1110 - DNA, 9 bp, Artificial Sequence
  Synthetic nucleic acid molecule
agcagcttc

SEQ ID NO: 1111 - DNA, 9 bp, Artificial Sequence
  Synthetic nucleic acid molecule
agcagcatc

SEQ ID NO: 1112 - DNA, 9 bp, Artificial Sequence
  Synthetic nucleic acid molecule
agcaacgtc

SEQ ID NO: 1113 - DNA, 9 bp, Artificial Sequence
  Synthetic nucleic acid molecule
agcagcggc

SEQ ID NO: 1114 - DNA, 9 bp, Artificial Sequence
  Synthetic nucleic acid molecule
agcaacgtc

SEQ ID NO: 1115 - DNA, 9 bp, Artificial Sequence
  Synthetic nucleic acid molecule
agtagcgtc

SEQ ID NO: 1116 - DNA, 9 bp, Artificial Sequence
  Synthetic nucleic acid molecule
agcagcgtt

SEQ ID NO: 1117 - DNA, 9 bp, Artificial Sequence
  Synthetic nucleic acid molecule
agcagcggc

SEQ ID NO: 1118 - DNA, 9 bp, Artificial Sequence
  Synthetic nucleic acid molecule
agcaaggtc

SEQ ID NO: 1119 - DNA, 9 bp, Artificial Sequence
  Synthetic nucleic acid molecule
agcatggtc

SEQ ID NO: 1120 - DNA, 9 bp, Artificial Sequence
  Synthetic nucleic acid molecule
agtagggtc

SEQ ID NO: 1121 - DNA, 9 bp, Artificial Sequence
  Synthetic nucleic acid molecule
atcagggtc

SEQ ID NO: 1122 - DNA, 9 bp, Artificial Sequence
  Synthetic nucleic acid molecule
agcatggtc

SEQ ID NO: 1123 - DNA, 9 bp, Artificial Sequence
  Synthetic nucleic acid molecule
agcagggta

SEQ ID NO: 1124 - DNA, 9 bp, Artificial Sequence
  Synthetic nucleic acid molecule
ggcaacgtc

SEQ ID NO: 1125 - DNA, 9 bp, Artificial Sequence
  Synthetic nucleic acid molecule
gccagcgtc

SEQ ID NO: 1126 - DNA, 9 bp, Artificial Sequence
  Synthetic nucleic acid molecule
agcagcttt

SEQ ID NO: 1127 - DNA, 9 bp, Artificial Sequence
  Synthetic nucleic acid molecule
agcagtggc

SEQ ID NO: 1128 - DNA, 9 bp, Artificial Sequence
  Synthetic nucleic acid molecule
ggcagcatc

SEQ ID NO: 1129 - DNA, 9 bp, Artificial Sequence
  Synthetic nucleic acid molecule
ggcagcatc

SEQ ID NO: 1130 - DNA, 9 bp, Artificial Sequence
  Synthetic nucleic acid molecule
agcagtgta

SEQ ID NO: 1131 - DNA, 9 bp, Artificial Sequence
  Synthetic nucleic acid molecule
aggagagtc

SEQ ID NO: 1132 - DNA, 9 bp, Artificial Sequence
  Synthetic nucleic acid molecule
agcatggtc

SEQ ID NO: 1133 - DNA, 9 bp, Artificial Sequence
  Synthetic nucleic acid molecule
atcagggtc

SEQ ID NO: 1134 - DNA, 9 bp, Artificial Sequence
  Synthetic nucleic acid molecule
aacagcgtg

SEQ ID NO: 1135 - DNA, 9 bp, Artificial Sequence
  Synthetic nucleic acid molecule
agtagcttc

SEQ ID NO: 1136 - DNA, 9 bp, Artificial Sequence
  Synthetic nucleic acid molecule
agcaacttc

SEQ ID NO: 1137 - DNA, 9 bp, Artificial Sequence
  Synthetic nucleic acid molecule
agcatggtc

SEQ ID NO: 1138 - DNA, 9 bp, Artificial Sequence
  Synthetic nucleic acid molecule
agaagtgtc

SEQ ID NO: 1139 - DNA, 9 bp, Artificial Sequence
  Synthetic nucleic acid molecule
aacagcggc

SEQ ID NO: 1140 - DNA, 9 bp, Artificial Sequence
  Synthetic nucleic acid molecule
agcagtggc

SEQ ID NO: 1141 - DNA, 9 bp, Artificial Sequence
  Synthetic nucleic acid molecule
aaaagtgtc

SEQ ID NO: 1142 - DNA, 9 bp, Artificial Sequence
  Synthetic nucleic acid molecule
agcaatggc

SEQ ID NO: 1143 - DNA, 9 bp, Artificial Sequence
  Synthetic nucleic acid molecule
gccaccgtc

SEQ ID NO: 1144 - DNA, 9 bp, Artificial Sequence
  Synthetic nucleic acid molecule
aaaagtgtc

SEQ ID NO: 1145 - DNA, 9 bp, Artificial Sequence
  Synthetic nucleic acid molecule
aacattgtc

SEQ ID NO: 1146 - DNA, 9 bp, Artificial Sequence
  Synthetic nucleic acid molecule
aacattgtc

SEQ ID NO: 1147 - DNA, 9 bp, Artificial Sequence
  Synthetic nucleic acid molecule
aacattgtc

SEQ ID NO: 1148 - DNA, 9 bp, Artificial Sequence
  Synthetic nucleic acid molecule
aacattgtc

SEQ ID NO: 1149 - DNA, 9 bp, Artificial Sequence
  Synthetic nucleic acid molecule
aacattgtc

SEQ ID NO: 1150 - DNA, 9 bp, Artificial Sequence
  Synthetic nucleic acid molecule
aacattgtc

SEQ ID NO: 1151 - DNA, 9 bp, Artificial Sequence
  Synthetic nucleic acid molecule
aacattgtc

SEQ ID NO: 1152 - DNA, 9 bp, Artificial Sequence
  Synthetic nucleic acid molecule
aacattgtc

SEQ ID NO: 1153 - DNA, 9 bp, Artificial Sequence
  Synthetic nucleic acid molecule
aacattgtc

SEQ ID NO: 1154 - DNA, 9 bp, Artificial Sequence
  Synthetic nucleic acid molecule
aacattgtc

SEQ ID NO: 1155 - DNA, 9 bp, Artificial Sequence
  Synthetic nucleic acid molecule
aacattgtc

SEQ ID NO: 1156 - DNA, 9 bp, Artificial Sequence
  Synthetic nucleic acid molecule
aacattgtc

SEQ ID NO: 1157 - DNA, 9 bp, Artificial Sequence
  Synthetic nucleic acid molecule
aacattgtc

SEQ ID NO: 1158 - DNA, 9 bp, Artificial Sequence
  Synthetic nucleic acid molecule
aacattgtc

SEQ ID NO: 1159 - DNA, 9 bp, Artificial Sequence
  Synthetic nucleic acid molecule
atcaacttc

SEQ ID NO: 1160 - DNA, 9 bp, Artificial Sequence
  Synthetic nucleic acid molecule
agcatggtg

SEQ ID NO: 1161 - DNA, 9 bp, Artificial Sequence
  Synthetic nucleic acid molecule
agtagtctc

SEQ ID NO: 1162 - DNA, 9 bp, Artificial Sequence
  Synthetic nucleic acid molecule
agcattgtt

SEQ ID NO: 1163 - DNA, 9 bp, Artificial Sequence
  Synthetic nucleic acid molecule
agcaaggtt

SEQ ID NO: 1164 - DNA, 9 bp, Artificial Sequence
  Synthetic nucleic acid molecule
agcagtctt

SEQ ID NO: 1165 - DNA, 9 bp, Artificial Sequence
  Synthetic nucleic acid molecule
agcattgtt

SEQ ID NO: 1166 - DNA, 9 bp, Artificial Sequence
  Synthetic nucleic acid molecule
agcagcgtc

SEQ ID NO: 1167 - DNA, 9 bp, Artificial Sequence
  Synthetic nucleic acid molecule
agcagcgtc

SEQ ID NO: 1168 - DNA, 9 bp, Artificial Sequence
  Synthetic nucleic acid molecule
ggcagcgtc

SEQ ID NO: 1169 - DNA, 9 bp, Artificial Sequence
  Synthetic nucleic acid molecule
agcagagtc

SEQ ID NO: 1170 - DNA, 9 bp, Artificial Sequence
  Synthetic nucleic acid molecule
agcagcatc

SEQ ID NO: 1171 - DNA, 9 bp, Artificial Sequence
  Synthetic nucleic acid molecule
agcagagtc

SEQ ID NO: 1172 - DNA, 9 bp, Artificial Sequence
  Synthetic nucleic acid molecule
agcagtgtc

SEQ ID NO: 1173 - DNA, 9 bp, Artificial Sequence
  Synthetic nucleic acid molecule
agcagcatc

SEQ ID NO: 1174 - DNA, 9 bp, Artificial Sequence
  Synthetic nucleic acid molecule
agctgcgtc

SEQ ID NO: 1175 - DNA, 9 bp, Artificial Sequence
  Synthetic nucleic acid molecule
agcagcttc

SEQ ID NO: 1176 - DNA, 9 bp, Artificial Sequence
  Synthetic nucleic acid molecule
agcagggtc

SEQ ID NO: 1177 - DNA, 9 bp, Artificial Sequence
  Synthetic nucleic acid molecule
agcagggtc

SEQ ID NO: 1178 - DNA, 9 bp, Artificial Sequence
  Synthetic nucleic acid molecule
agcagcatc

SEQ ID NO: 1179 - DNA, 9 bp, Artificial Sequence
  Synthetic nucleic acid molecule
agcagagtc

SEQ ID NO: 1180 - DNA, 9 bp, Artificial Sequence
  Synthetic nucleic acid molecule
agcagcctc

SEQ ID NO: 1181 - DNA, 9 bp, Artificial Sequence
  Synthetic nucleic acid molecule
agcagcctc

SEQ ID NO: 1182 - DNA, 9 bp, Artificial Sequence
  Synthetic nucleic acid molecule
agcagcttc

SEQ ID NO: 1183 - DNA, 9 bp, Artificial Sequence
  Synthetic nucleic acid molecule
agcagcctc

SEQ ID NO: 1184 - DNA, 9 bp, Artificial Sequence
  Synthetic nucleic acid molecule
agcagcatc

SEQ ID NO: 1185 - DNA, 9 bp, Artificial Sequence
  Synthetic nucleic acid molecule
agcagcgtg

SEQ ID NO: 1186 - DNA, 9 bp, Artificial Sequence
  Synthetic nucleic acid molecule
agcagcatc

SEQ ID NO: 1187 - DNA, 9 bp, Artificial Sequence
  Synthetic nucleic acid molecule
agcagcatc

SEQ ID NO: 1188 - DNA, 9 bp, Artificial Sequence
  Synthetic nucleic acid molecule
agcagagtc

SEQ ID NO: 1189 - DNA, 9 bp, Artificial Sequence
  Synthetic nucleic acid molecule
ggcagcgtc

SEQ ID NO: 1190 - DNA, 9 bp, Artificial Sequence
  Synthetic nucleic acid molecule
agcagcgcc

SEQ ID NO: 1191 - DNA, 9 bp, Artificial Sequence
  Synthetic nucleic acid molecule
agctgcgtc

SEQ ID NO: 1192 - DNA, 9 bp, Artificial Sequence
  Synthetic nucleic acid molecule
agcagggtc

SEQ ID NO: 1193 - DNA, 9 bp, Artificial Sequence
  Synthetic nucleic acid molecule
agcagagtc

SEQ ID NO: 1194 - DNA, 9 bp, Artificial Sequence
  Synthetic nucleic acid molecule
agcagagtc

SEQ ID NO: 1195 - DNA, 9 bp, Artificial Sequence
  Synthetic nucleic acid molecule
agcagtgtc

SEQ ID NO: 1196 - DNA, 9 bp, Artificial Sequence
  Synthetic nucleic acid molecule
agcagtgtc

SEQ ID NO: 1197 - DNA, 9 bp, Artificial Sequence
  Synthetic nucleic acid molecule
agcagcatc

SEQ ID NO: 1198 - DNA, 9 bp, Artificial Sequence
  Synthetic nucleic acid molecule
aacagcgtc

SEQ ID NO: 1199 - DNA, 9 bp, Artificial Sequence
  Synthetic nucleic acid molecule
agcagcgcc

SEQ ID NO: 1200 - DNA, 9 bp, Artificial Sequence
  Synthetic nucleic acid molecule
agcagcgcc

SEQ ID NO: 1201 - DNA, 9 bp, Artificial Sequence
  Synthetic nucleic acid molecule
agcagcgcc

SEQ ID NO: 1202 - DNA, 9 bp, Artificial Sequence
  Synthetic nucleic acid molecule
agcagcgcc

SEQ ID NO: 1203 - DNA, 9 bp, Artificial Sequence
  Synthetic nucleic acid molecule
agcagcgcc

SEQ ID NO: 1204 - DNA, 9 bp, Artificial Sequence
  Synthetic nucleic acid molecule
agcagcgcc

SEQ ID NO: 1205 - DNA, 9 bp, Artificial Sequence
  Synthetic nucleic acid molecule
agcagcgcc

SEQ ID NO: 1206 - DNA, 9 bp, Artificial Sequence
  Synthetic nucleic acid molecule
agcagcgcc

SEQ ID NO: 1207 - DNA, 9 bp, Artificial Sequence
  Synthetic nucleic acid molecule
agcagcatc

SEQ ID NO: 1208 - DNA, 9 bp, Artificial Sequence
  Synthetic nucleic acid molecule
agcagagtc

SEQ ID NO: 1209 - DNA, 9 bp, Artificial Sequence
  Synthetic nucleic acid molecule
agcagcctc

SEQ ID NO: 1210 - DNA, 9 bp, Artificial Sequence
  Synthetic nucleic acid molecule
agcagcatc

SEQ ID NO: 1211 - DNA, 9 bp, Artificial Sequence
  Synthetic nucleic acid molecule
agcagtgtc

SEQ ID NO: 1212 - DNA, 9 bp, Artificial Sequence
  Synthetic nucleic acid molecule
agcagagtc

SEQ ID NO: 1213 - DNA, 9 bp, Artificial Sequence
  Synthetic nucleic acid molecule
agcagcgtg

SEQ ID NO: 1214 - DNA, 9 bp, Artificial Sequence
  Synthetic nucleic acid molecule
accagcgtc

SEQ ID NO: 1215 - DNA, 9 bp, Artificial Sequence
  Synthetic nucleic acid molecule
agcagtgtc

SEQ ID NO: 1216 - DNA, 9 bp, Artificial Sequence
  Synthetic nucleic acid molecule
agcagcgac

SEQ ID NO: 1217 - DNA, 9 bp, Artificial Sequence
  Synthetic nucleic acid molecule
agcagtgtc

SEQ ID NO: 1218 - DNA, 9 bp, Artificial Sequence
  Synthetic nucleic acid molecule
agcagcgta

SEQ ID NO: 1219 - DNA, 9 bp, Artificial Sequence
  Synthetic nucleic acid molecule
agcagcctc

SEQ ID NO: 1220 - DNA, 9 bp, Artificial Sequence
  Synthetic nucleic acid molecule
agcagagtc

SEQ ID NO: 1221 - DNA, 9 bp, Artificial Sequence
  Synthetic nucleic acid molecule
tgcagcgtc

SEQ ID NO: 1222 - DNA, 9 bp, Artificial Sequence
  Synthetic nucleic acid molecule
agcagggac

SEQ ID NO: 1223 - DNA, 9 bp, Artificial Sequence
  Synthetic nucleic acid molecule
agcaggctc

SEQ ID NO: 1224 - DNA, 9 bp, Artificial Sequence
  Synthetic nucleic acid molecule
agcagccta

SEQ ID NO: 1225 - DNA, 9 bp, Artificial Sequence
  Synthetic nucleic acid molecule
agcatcctc

SEQ ID NO: 1226 - DNA, 9 bp, Artificial Sequence
  Synthetic nucleic acid molecule
agcagagta

SEQ ID NO: 1227 - DNA, 9 bp, Artificial Sequence
  Synthetic nucleic acid molecule
agcagggta

SEQ ID NO: 1228 - DNA, 9 bp, Artificial Sequence
  Synthetic nucleic acid molecule
agcagagac

SEQ ID NO: 1229 - DNA, 9 bp, Artificial Sequence
  Synthetic nucleic acid molecule
agcagagtg

SEQ ID NO: 1230 - DNA, 9 bp, Artificial Sequence
  Synthetic nucleic acid molecule
agctgcctc

SEQ ID NO: 1231 - DNA, 9 bp, Artificial Sequence
  Synthetic nucleic acid molecule
aggagggtc

SEQ ID NO: 1232 - DNA, 9 bp, Artificial Sequence
  Synthetic nucleic acid molecule
agcagactc

SEQ ID NO: 1233 - DNA, 9 bp, Artificial Sequence
  Synthetic nucleic acid molecule
agcagagta

SEQ ID NO: 1234 - DNA, 9 bp, Artificial Sequence
  Synthetic nucleic acid molecule
agcagagtt

SEQ ID NO: 1235 - DNA, 9 bp, Artificial Sequence
  Synthetic nucleic acid molecule
agcagcacc

SEQ ID NO: 1236 - DNA, 9 bp, Artificial Sequence
  Synthetic nucleic acid molecule
agcaggatc

SEQ ID NO: 1237 - DNA, 9 bp, Artificial Sequence
  Synthetic nucleic acid molecule
tgcagcatc

SEQ ID NO: 1238 - DNA, 9 bp, Artificial Sequence
  Synthetic nucleic acid molecule
agcagagtg

SEQ ID NO: 1239 - DNA, 9 bp, Artificial Sequence
  Synthetic nucleic acid molecule
agcagtgcc

SEQ ID NO: 1240 - DNA, 9 bp, Artificial Sequence
  Synthetic nucleic acid molecule
agcagagta

SEQ ID NO: 1241 - DNA, 9 bp, Artificial Sequence
  Synthetic nucleic acid molecule
agcagagtg

SEQ ID NO: 1242 - DNA, 9 bp, Artificial Sequence
  Synthetic nucleic acid molecule
agcaggatc

SEQ ID NO: 1243 - DNA, 9 bp, Artificial Sequence
  Synthetic nucleic acid molecule
agcagcttg

SEQ ID NO: 1244 - DNA, 9 bp, Artificial Sequence
  Synthetic nucleic acid molecule
agcagagta

SEQ ID NO: 1245 - DNA, 9 bp, Artificial Sequence
  Synthetic nucleic acid molecule
agcagcgtc

SEQ ID NO: 1246 - DNA, 9 bp, Artificial Sequence
  Synthetic nucleic acid molecule
agcagcgtc

SEQ ID NO: 1247 - DNA, 9 bp, Artificial Sequence
  Synthetic nucleic acid molecule
agcagcgtc

SEQ ID NO: 1248 - DNA, 9 bp, Artificial Sequence
  Synthetic nucleic acid molecule
agcagcgtc

SEQ ID NO: 1249 - DNA, 9 bp, Artificial Sequence
  Synthetic nucleic acid molecule
agcagcgtc

SEQ ID NO: 1250 - DNA, 9 bp, Artificial Sequence
  Synthetic nucleic acid molecule
agcagcgtc

SEQ ID NO: 1251 - DNA, 9 bp, Artificial Sequence
  Synthetic nucleic acid molecule
agcagcgtc

SEQ ID NO: 1252 - DNA, 9 bp, Artificial Sequence
  Synthetic nucleic acid molecule
agcagcgtc

SEQ ID NO: 1253 - DNA, 9 bp, Artificial Sequence
  Synthetic nucleic acid molecule
agcagcgtc

SEQ ID NO: 1254 - DNA, 9 bp, Artificial Sequence
  Synthetic nucleic acid molecule
agcagcgtc

SEQ ID NO: 1255 - DNA, 9 bp, Artificial Sequence
  Synthetic nucleic acid molecule
agcagcgtc

SEQ ID NO: 1256 - DNA, 9 bp, Artificial Sequence
  Synthetic nucleic acid molecule
agcagcgtc

SEQ ID NO: 1257 - DNA, 9 bp, Artificial Sequence
  Synthetic nucleic acid molecule
agcagcgtc

SEQ ID NO: 1258 - DNA, 9 bp, Artificial Sequence
  Synthetic nucleic acid molecule
agcagcgtc

SEQ ID NO: 1259 - DNA, 9 bp, Artificial Sequence
  Synthetic nucleic acid molecule
agcagcgtc

SEQ ID NO: 1260 - DNA, 9 bp, Artificial Sequence
  Synthetic nucleic acid molecule
agcagcgtc

SEQ ID NO: 1261 - DNA, 9 bp, Artificial Sequence
  Synthetic nucleic acid molecule
agcagcgtc

SEQ ID NO: 1262 - DNA, 9 bp, Artificial Sequence
  Synthetic nucleic acid molecule
agcagcgtc

SEQ ID NO: 1263 - DNA, 9 bp, Artificial Sequence
  Synthetic nucleic acid molecule
agcagcgtc

SEQ ID NO: 1264 - DNA, 9 bp, Artificial Sequence
  Synthetic nucleic acid molecule
agcagcgtc

SEQ ID NO: 1265 - DNA, 9 bp, Artificial Sequence
  Synthetic nucleic acid molecule
agcagcgtc

SEQ ID NO: 1266 - DNA, 9 bp, Artificial Sequence
  Synthetic nucleic acid molecule
agcagcgtc

SEQ ID NO: 1267 - DNA, 9 bp, Artificial Sequence
  Synthetic nucleic acid molecule
agcagcgtc

SEQ ID NO: 1268 - DNA, 9 bp, Artificial Sequence
  Synthetic nucleic acid molecule
agcagcgtc

SEQ ID NO: 1269 - DNA, 9 bp, Artificial Sequence
  Synthetic nucleic acid molecule
agcagcgtc

SEQ ID NO: 1270 - DNA, 9 bp, Artificial Sequence
  Synthetic nucleic acid molecule
agcagcgtc

SEQ ID NO: 1271 - DNA, 9 bp, Artificial Sequence
  Synthetic nucleic acid molecule
agcagcgtc

SEQ ID NO: 1272 - DNA, 9 bp, Artificial Sequence
  Synthetic nucleic acid molecule
agcagcgtc

SEQ ID NO: 1273 - DNA, 9 bp, Artificial Sequence
  Synthetic nucleic acid molecule
agcagcgtc

SEQ ID NO: 1274 - DNA, 9 bp, Artificial Sequence
  Synthetic nucleic acid molecule
agcagcgtc

SEQ ID NO: 1275 - DNA, 9 bp, Artificial Sequence
  Synthetic nucleic acid molecule
agcagcgtc

SEQ ID NO: 1276 - DNA, 9 bp, Artificial Sequence
  Synthetic nucleic acid molecule
agcagcgtc

SEQ ID NO: 1277 - DNA, 9 bp, Artificial Sequence
  Synthetic nucleic acid molecule
agcagcgtc

SEQ ID NO: 1278 - DNA, 9 bp, Artificial Sequence
  Synthetic nucleic acid molecule
agcagcgtc

SEQ ID NO: 1279 - DNA, 9 bp, Artificial Sequence
  Synthetic nucleic acid molecule
agcagcgtc

SEQ ID NO: 1280 - DNA, 9 bp, Artificial Sequence
  Synthetic nucleic acid molecule
agcagcgtc

SEQ ID NO: 1281 - DNA, 9 bp, Artificial Sequence
  Synthetic nucleic acid molecule
agcagcgtc

SEQ ID NO: 1282 - DNA, 9 bp, Artificial Sequence
  Synthetic nucleic acid molecule
agcagcgtc

SEQ ID NO: 1283 - DNA, 9 bp, Artificial Sequence
  Synthetic nucleic acid molecule
agcagcgtc

SEQ ID NO: 1284 - DNA, 9 bp, Artificial Sequence
  Synthetic nucleic acid molecule
agcagcgtc

SEQ ID NO: 1285 - DNA, 9 bp, Artificial Sequence
  Synthetic nucleic acid molecule
agcagcgtc

SEQ ID NO: 1286 - DNA, 9 bp, Artificial Sequence
  Synthetic nucleic acid molecule
agcagcgtc

SEQ ID NO: 1287 - DNA, 9 bp, Artificial Sequence
  Synthetic nucleic acid molecule
agcagcgtc

SEQ ID NO: 1288 - DNA, 9 bp, Artificial Sequence
  Synthetic nucleic acid molecule
agcagcgtc

SEQ ID NO: 1289 - DNA, 9 bp, Artificial Sequence
  Synthetic nucleic acid molecule
agcagcgtc

SEQ ID NO: 1290 - DNA, 9 bp, Artificial Sequence
  Synthetic nucleic acid molecule
agcagcgtc

SEQ ID NO: 1291 - DNA, 9 bp, Artificial Sequence
  Synthetic nucleic acid molecule
agcagcgtc

SEQ ID NO: 1292 - DNA, 9 bp, Artificial Sequence
  Synthetic nucleic acid molecule
agcagcgtc

SEQ ID NO: 1293 - DNA, 9 bp, Artificial Sequence
  Synthetic nucleic acid molecule
agcagcgtc

SEQ ID NO: 1294 - DNA, 9 bp, Artificial Sequence
  Synthetic nucleic acid molecule
agcagcgtc

SEQ ID NO: 1295 - DNA, 9 bp, Artificial Sequence
  Synthetic nucleic acid molecule
agcagcgtc

SEQ ID NO: 1296 - DNA, 9 bp, Artificial Sequence
  Synthetic nucleic acid molecule
agcagcgtc

SEQ ID NO: 1297 - DNA, 9 bp, Artificial Sequence
  Synthetic nucleic acid molecule
agcagcgtc

SEQ ID NO: 1298 - DNA, 9 bp, Artificial Sequence
  Synthetic nucleic acid molecule
agcagcgtc

SEQ ID NO: 1299 - DNA, 9 bp, Artificial Sequence
  Synthetic nucleic acid molecule
agcagcgtc

SEQ ID NO: 1300 - DNA, 9 bp, Artificial Sequence
  Synthetic nucleic acid molecule
agcagcgtc

SEQ ID NO: 1301 - DNA, 9 bp, Artificial Sequence
  Synthetic nucleic acid molecule
agtagcgtc

SEQ ID NO: 1302 - DNA, 9 bp, Artificial Sequence
  Synthetic nucleic acid molecule
agcagcttc

SEQ ID NO: 1303 - DNA, 9 bp, Artificial Sequence
  Synthetic nucleic acid molecule
agcagggtc

SEQ ID NO: 1304 - DNA, 9 bp, Artificial Sequence
  Synthetic nucleic acid molecule
agcagcatc

SEQ ID NO: 1305 - DNA, 9 bp, Artificial Sequence
  Synthetic nucleic acid molecule
agcagggtc

SEQ ID NO: 1306 - DNA, 9 bp, Artificial Sequence
  Synthetic nucleic acid molecule
agcagcggc

SEQ ID NO: 1307 - DNA, 9 bp, Artificial Sequence
  Synthetic nucleic acid molecule
ggcagcgtc

SEQ ID NO: 1308 - DNA, 9 bp, Artificial Sequence
  Synthetic nucleic acid molecule
agcagtgtc

SEQ ID NO: 1309 - DNA, 9 bp, Artificial Sequence
  Synthetic nucleic acid molecule
agcagggtc

SEQ ID NO: 1310 - DNA, 9 bp, Artificial Sequence
  Synthetic nucleic acid molecule
agcagtgtc

SEQ ID NO: 1311 - DNA, 9 bp, Artificial Sequence
  Synthetic nucleic acid molecule
agcaccgtc

SEQ ID NO: 1312 - DNA, 9 bp, Artificial Sequence
  Synthetic nucleic acid molecule
agcagcatc

SEQ ID NO: 1313 - DNA, 9 bp, Artificial Sequence
  Synthetic nucleic acid molecule
agcagcctc

SEQ ID NO: 1314 - DNA, 9 bp, Artificial Sequence
  Synthetic nucleic acid molecule
ggcagcgtc

SEQ ID NO: 1315 - DNA, 9 bp, Artificial Sequence
  Synthetic nucleic acid molecule
agcaacgtc

SEQ ID NO: 1316 - DNA, 9 bp, Artificial Sequence
  Synthetic nucleic acid molecule
agcaacgtc

SEQ ID NO: 1317 - DNA, 9 bp, Artificial Sequence
  Synthetic nucleic acid molecule
agcagggtc

SEQ ID NO: 1318 - DNA, 9 bp, Artificial Sequence
  Synthetic nucleic acid molecule
agcagggtc

SEQ ID NO: 1319 - DNA, 9 bp, Artificial Sequence
  Synthetic nucleic acid molecule
agcagtgtc

SEQ ID NO: 1320 - DNA, 9 bp, Artificial Sequence
  Synthetic nucleic acid molecule
agcagggtc

SEQ ID NO: 1321 - DNA, 9 bp, Artificial Sequence
  Synthetic nucleic acid molecule
agcagcgta

SEQ ID NO: 1322 - DNA, 9 bp, Artificial Sequence
  Synthetic nucleic acid molecule
agcagcttc

SEQ ID NO: 1323 - DNA, 9 bp, Artificial Sequence
  Synthetic nucleic acid molecule
agcagcggc

SEQ ID NO: 1324 - DNA, 9 bp, Artificial Sequence
  Synthetic nucleic acid molecule
agcagtgtc

SEQ ID NO: 1325 - DNA, 9 bp, Artificial Sequence
  Synthetic nucleic acid molecule
agcagggtc

SEQ ID NO: 1326 - DNA, 9 bp, Artificial Sequence
  Synthetic nucleic acid molecule
agcagcttc

SEQ ID NO: 1327 - DNA, 9 bp, Artificial Sequence
  Synthetic nucleic acid molecule
agcaccgtc

SEQ ID NO: 1328 - DNA, 9 bp, Artificial Sequence
  Synthetic nucleic acid molecule
agcatcgtc

SEQ ID NO: 1329 - DNA, 9 bp, Artificial Sequence
  Synthetic nucleic acid molecule
agcagggtc

SEQ ID NO: 1330 - DNA, 9 bp, Artificial Sequence
  Synthetic nucleic acid molecule
agcagagtc

SEQ ID NO: 1331 - DNA, 9 bp, Artificial Sequence
  Synthetic nucleic acid molecule
agcagcgtg

SEQ ID NO: 1332 - DNA, 9 bp, Artificial Sequence
  Synthetic nucleic acid molecule
agcaccgtc

SEQ ID NO: 1333 - DNA, 9 bp, Artificial Sequence
  Synthetic nucleic acid molecule
agcagcttc

SEQ ID NO: 1334 - DNA, 9 bp, Artificial Sequence
  Synthetic nucleic acid molecule
agcagagtc

SEQ ID NO: 1335 - DNA, 9 bp, Artificial Sequence
  Synthetic nucleic acid molecule
agcagcttc

SEQ ID NO: 1336 - DNA, 9 bp, Artificial Sequence
  Synthetic nucleic acid molecule
agcagcttc

SEQ ID NO: 1337 - DNA, 9 bp, Artificial Sequence
  Synthetic nucleic acid molecule
agcagcttc

SEQ ID NO: 1338 - DNA, 9 bp, Artificial Sequence
  Synthetic nucleic acid molecule
agcagcttc

SEQ ID NO: 1339 - DNA, 9 bp, Artificial Sequence
  Synthetic nucleic acid molecule
agcagcttc

SEQ ID NO: 1340 - DNA, 9 bp, Artificial Sequence
  Synthetic nucleic acid molecule
agcagcttc

SEQ ID NO: 1341 - DNA, 9 bp, Artificial Sequence
  Synthetic nucleic acid molecule
agcagagtc

SEQ ID NO: 1342 - DNA, 9 bp, Artificial Sequence
  Synthetic nucleic acid molecule
agcagcttc

SEQ ID NO: 1343 - DNA, 9 bp, Artificial Sequence
  Synthetic nucleic acid molecule
agcagcgta

SEQ ID NO: 1344 - DNA, 9 bp, Artificial Sequence
  Synthetic nucleic acid molecule
agcagtgtc

SEQ ID NO: 1345 - DNA, 9 bp, Artificial Sequence
  Synthetic nucleic acid molecule
agcagagtc

SEQ ID NO: 1346 - DNA, 9 bp, Artificial Sequence
  Synthetic nucleic acid molecule
agcagcgtg

SEQ ID NO: 1347 - DNA, 9 bp, Artificial Sequence
  Synthetic nucleic acid molecule
ggcagcgtc

SEQ ID NO: 1348 - DNA, 9 bp, Artificial Sequence
  Synthetic nucleic acid molecule
agcagcttc

SEQ ID NO: 1349 - DNA, 9 bp, Artificial Sequence
  Synthetic nucleic acid molecule
atcagcgtc

SEQ ID NO: 1350 - DNA, 9 bp, Artificial Sequence
  Synthetic nucleic acid molecule
agcagcggc

SEQ ID NO: 1351 - DNA, 9 bp, Artificial Sequence
  Synthetic nucleic acid molecule
agcagcttc

SEQ ID NO: 1352 - DNA, 9 bp, Artificial Sequence
  Synthetic nucleic acid molecule
agcagcttc

SEQ ID NO: 1353 - DNA, 9 bp, Artificial Sequence
  Synthetic nucleic acid molecule
agcagcatc

SEQ ID NO: 1354 - DNA, 9 bp, Artificial Sequence
  Synthetic nucleic acid molecule
agcagagtc

SEQ ID NO: 1355 - DNA, 9 bp, Artificial Sequence
  Synthetic nucleic acid molecule
agcagggtc

SEQ ID NO: 1356 - DNA, 9 bp, Artificial Sequence
  Synthetic nucleic acid molecule
agcagagtc

SEQ ID NO: 1357 - DNA, 9 bp, Artificial Sequence
  Synthetic nucleic acid molecule
agcagagtc

SEQ ID NO: 1358 - DNA, 9 bp, Artificial Sequence
  Synthetic nucleic acid molecule
tgcagcgtc

SEQ ID NO: 1359 - DNA, 9 bp, Artificial Sequence
  Synthetic nucleic acid molecule
agcatcgtc

SEQ ID NO: 1360 - DNA, 9 bp, Artificial Sequence
  Synthetic nucleic acid molecule
agcagtgtc

SEQ ID NO: 1361 - DNA, 9 bp, Artificial Sequence
  Synthetic nucleic acid molecule
agcagcttc

SEQ ID NO: 1362 - DNA, 9 bp, Artificial Sequence
  Synthetic nucleic acid molecule
agcagggtc

SEQ ID NO: 1363 - DNA, 9 bp, Artificial Sequence
  Synthetic nucleic acid molecule
agcagtgtc

SEQ ID NO: 1364 - DNA, 9 bp, Artificial Sequence
  Synthetic nucleic acid molecule
agcagggtc

SEQ ID NO: 1365 - DNA, 9 bp, Artificial Sequence
  Synthetic nucleic acid molecule
agcagcatc

SEQ ID NO: 1366 - DNA, 9 bp, Artificial Sequence
  Synthetic nucleic acid molecule
agcagtgtc

SEQ ID NO: 1367 - DNA, 9 bp, Artificial Sequence
  Synthetic nucleic acid molecule
agcagcttc

SEQ ID NO: 1368 - DNA, 9 bp, Artificial Sequence
  Synthetic nucleic acid molecule
agcagagtc

SEQ ID NO: 1369 - DNA, 9 bp, Artificial Sequence
  Synthetic nucleic acid molecule
agcagtgtc

SEQ ID NO: 1370 - DNA, 9 bp, Artificial Sequence
  Synthetic nucleic acid molecule
agcatcgtc

SEQ ID NO: 1371 - DNA, 9 bp, Artificial Sequence
  Synthetic nucleic acid molecule
agcagggtc

SEQ ID NO: 1372 - DNA, 9 bp, Artificial Sequence
  Synthetic nucleic acid molecule
agcagagtc

SEQ ID NO: 1373 - DNA, 9 bp, Artificial Sequence
  Synthetic nucleic acid molecule
agcagcggc

SEQ ID NO: 1374 - DNA, 9 bp, Artificial Sequence
  Synthetic nucleic acid molecule
agcagagtc

SEQ ID NO: 1375 - DNA, 9 bp, Artificial Sequence
  Synthetic nucleic acid molecule
agcagcggc

SEQ ID NO: 1376 - DNA, 9 bp, Artificial Sequence
  Synthetic nucleic acid molecule
agcagcggc

SEQ ID NO: 1377 - DNA, 9 bp, Artificial Sequence
  Synthetic nucleic acid molecule
agcagcggc

SEQ ID NO: 1378 - DNA, 9 bp, Artificial Sequence
  Synthetic nucleic acid molecule
agcagcggc

SEQ ID NO: 1379 - DNA, 9 bp, Artificial Sequence
  Synthetic nucleic acid molecule
agcagcggc

SEQ ID NO: 1380 - DNA, 9 bp, Artificial Sequence
  Synthetic nucleic acid molecule
agcagcggc

SEQ ID NO: 1381 - DNA, 9 bp, Artificial Sequence
  Synthetic nucleic acid molecule
agcagcggc

SEQ ID NO: 1382 - DNA, 9 bp, Artificial Sequence
  Synthetic nucleic acid molecule
agcagcggc

SEQ ID NO: 1383 - DNA, 9 bp, Artificial Sequence
  Synthetic nucleic acid molecule
agcagcggc

SEQ ID NO: 1384 - DNA, 9 bp, Artificial Sequence
  Synthetic nucleic acid molecule
tgcagcgtc

SEQ ID NO: 1385 - DNA, 9 bp, Artificial Sequence
  Synthetic nucleic acid molecule
agcagtgtc

SEQ ID NO: 1386 - DNA, 9 bp, Artificial Sequence
  Synthetic nucleic acid molecule
agcagcgta

SEQ ID NO: 1387 - DNA, 9 bp, Artificial Sequence
  Synthetic nucleic acid molecule
agcatcgtc

SEQ ID NO: 1388 - DNA, 9 bp, Artificial Sequence
  Synthetic nucleic acid molecule
agcagcggc

SEQ ID NO: 1389 - DNA, 9 bp, Artificial Sequence
  Synthetic nucleic acid molecule
agcagcgtt

SEQ ID NO: 1390 - DNA, 9 bp, Artificial Sequence
  Synthetic nucleic acid molecule
agcagagtc

SEQ ID NO: 1391 - DNA, 9 bp, Artificial Sequence
  Synthetic nucleic acid molecule
agcagtgtc

SEQ ID NO: 1392 - DNA, 9 bp, Artificial Sequence
  Synthetic nucleic acid molecule
agcagcatc

SEQ ID NO: 1393 - DNA, 9 bp, Artificial Sequence
  Synthetic nucleic acid molecule
agcaacgtc

SEQ ID NO: 1394 - DNA, 9 bp, Artificial Sequence
  Synthetic nucleic acid molecule
agcaccgtc

SEQ ID NO: 1395 - DNA, 9 bp, Artificial Sequence
  Synthetic nucleic acid molecule
agcagggtc

SEQ ID NO: 1396 - DNA, 9 bp, Artificial Sequence
  Synthetic nucleic acid molecule
ggcagcgtc

SEQ ID NO: 1397 - DNA, 9 bp, Artificial Sequence
  Synthetic nucleic acid molecule
agcatcgtc

SEQ ID NO: 1398 - DNA, 9 bp, Artificial Sequence
  Synthetic nucleic acid molecule
agcagtgtc

SEQ ID NO: 1399 - DNA, 9 bp, Artificial Sequence
  Synthetic nucleic acid molecule
agcagtgtc

SEQ ID NO: 1400 - DNA, 9 bp, Artificial Sequence
  Synthetic nucleic acid molecule
agcagcgtt

SEQ ID NO: 1401 - DNA, 9 bp, Artificial Sequence
  Synthetic nucleic acid molecule
agcagcggc

SEQ ID NO: 1402 - DNA, 9 bp, Artificial Sequence
  Synthetic nucleic acid molecule
agcaccgtc

SEQ ID NO: 1403 - DNA, 9 bp, Artificial Sequence
  Synthetic nucleic acid molecule
agcagtgtc

SEQ ID NO: 1404 - DNA, 9 bp, Artificial Sequence
  Synthetic nucleic acid molecule
agcagcgcc

SEQ ID NO: 1405 - DNA, 9 bp, Artificial Sequence
  Synthetic nucleic acid molecule
agcagagtc

SEQ ID NO: 1406 - DNA, 9 bp, Artificial Sequence
  Synthetic nucleic acid molecule
agcagcttc

SEQ ID NO: 1407 - DNA, 9 bp, Artificial Sequence
  Synthetic nucleic acid molecule
agcagcttc

SEQ ID NO: 1408 - DNA, 9 bp, Artificial Sequence
  Synthetic nucleic acid molecule
agcagcttc

SEQ ID NO: 1409 - DNA, 9 bp, Artificial Sequence
  Synthetic nucleic acid molecule
agcagcttc

SEQ ID NO: 1410 - DNA, 9 bp, Artificial Sequence
  Synthetic nucleic acid molecule
agcagcttc

SEQ ID NO: 1411 - DNA, 9 bp, Artificial Sequence
  Synthetic nucleic acid molecule
agcagcttc

SEQ ID NO: 1412 - DNA, 9 bp, Artificial Sequence
  Synthetic nucleic acid molecule
agcagcttc

SEQ ID NO: 1413 - DNA, 9 bp, Artificial Sequence
  Synthetic nucleic acid molecule
agcagcttc

SEQ ID NO: 1414 - DNA, 9 bp, Artificial Sequence
  Synthetic nucleic acid molecule
agcagcttc

SEQ ID NO: 1415 - DNA, 9 bp, Artificial Sequence
  Synthetic nucleic acid molecule
agcagcttc

SEQ ID NO: 1416 - DNA, 9 bp, Artificial Sequence
  Synthetic nucleic acid molecule
agcagcttc

SEQ ID NO: 1417 - DNA, 9 bp, Artificial Sequence
  Synthetic nucleic acid molecule
agcagcttc

SEQ ID NO: 1418 - DNA, 9 bp, Artificial Sequence
  Synthetic nucleic acid molecule
agcagcttc

SEQ ID NO: 1419 - DNA, 9 bp, Artificial Sequence
  Synthetic nucleic acid molecule
agcagcttc

SEQ ID NO: 1420 - DNA, 9 bp, Artificial Sequence
  Synthetic nucleic acid molecule
agcagagtc

SEQ ID NO: 1421 - DNA, 9 bp, Artificial Sequence
  Synthetic nucleic acid molecule
agcagggtc

SEQ ID NO: 1422 - DNA, 9 bp, Artificial Sequence
  Synthetic nucleic acid molecule
agcagggtc

SEQ ID NO: 1423 - DNA, 9 bp, Artificial Sequence
  Synthetic nucleic acid molecule
ggcagcgtc

SEQ ID NO: 1424 - DNA, 9 bp, Artificial Sequence
  Synthetic nucleic acid molecule
agcagcgtg

SEQ ID NO: 1425 - DNA, 9 bp, Artificial Sequence
  Synthetic nucleic acid molecule
agcaccgtc

SEQ ID NO: 1426 - DNA, 9 bp, Artificial Sequence
  Synthetic nucleic acid molecule
agcagcttc

SEQ ID NO: 1427 - DNA, 9 bp, Artificial Sequence
  Synthetic nucleic acid molecule
agcagcatc

SEQ ID NO: 1428 - DNA, 9 bp, Artificial Sequence
  Synthetic nucleic acid molecule
agcagcgtg

SEQ ID NO: 1429 - DNA, 9 bp, Artificial Sequence
  Synthetic nucleic acid molecule
agcagcggc

SEQ ID NO: 1430 - DNA, 9 bp, Artificial Sequence
  Synthetic nucleic acid molecule
agcagggtc

SEQ ID NO: 1431 - DNA, 9 bp, Artificial Sequence
  Synthetic nucleic acid molecule
agcagcggc

SEQ ID NO: 1432 - DNA, 9 bp, Artificial Sequence
  Synthetic nucleic acid molecule
agctgcgtc

SEQ ID NO: 1433 - DNA, 9 bp, Artificial Sequence
  Synthetic nucleic acid molecule
agcagggtc

SEQ ID NO: 1434 - DNA, 9 bp, Artificial Sequence
  Synthetic nucleic acid molecule
agcagcatc

SEQ ID NO: 1435 - DNA, 9 bp, Artificial Sequence
  Synthetic nucleic acid molecule
agcagtgtc

SEQ ID NO: 1436 - DNA, 9 bp, Artificial Sequence
  Synthetic nucleic acid molecule
agcagcgac

SEQ ID NO: 1437 - DNA, 9 bp, Artificial Sequence
  Synthetic nucleic acid molecule
agcagggtc

SEQ ID NO: 1438 - DNA, 9 bp, Artificial Sequence
  Synthetic nucleic acid molecule
agctgtgtc

SEQ ID NO: 1439 - DNA, 9 bp, Artificial Sequence
  Synthetic nucleic acid molecule
agctgggtc

SEQ ID NO: 1440 - DNA, 9 bp, Artificial Sequence
  Synthetic nucleic acid molecule
agctgggtc

SEQ ID NO: 1441 - DNA, 9 bp, Artificial Sequence
  Synthetic nucleic acid molecule
ggcagcggc

SEQ ID NO: 1442 - DNA, 9 bp, Artificial Sequence
  Synthetic nucleic acid molecule
agcatggtc

SEQ ID NO: 1443 - DNA, 9 bp, Artificial Sequence
  Synthetic nucleic acid molecule
atcagcctc

SEQ ID NO: 1444 - DNA, 9 bp, Artificial Sequence
  Synthetic nucleic acid molecule
agcatggtc

SEQ ID NO: 1445 - DNA, 9 bp, Artificial Sequence
  Synthetic nucleic acid molecule
agcaggggc

SEQ ID NO: 1446 - DNA, 9 bp, Artificial Sequence
  Synthetic nucleic acid molecule
aacagcgtg

SEQ ID NO: 1447 - DNA, 9 bp, Artificial Sequence
  Synthetic nucleic acid molecule
aacagagtc

SEQ ID NO: 1448 - DNA, 9 bp, Artificial Sequence
  Synthetic nucleic acid molecule
aacagcatc

SEQ ID NO: 1449 - DNA, 9 bp, Artificial Sequence
  Synthetic nucleic acid molecule
atcagtgtc

SEQ ID NO: 1450 - DNA, 9 bp, Artificial Sequence
  Synthetic nucleic acid molecule
agcagctgc

SEQ ID NO: 1451 - DNA, 9 bp, Artificial Sequence
  Synthetic nucleic acid molecule
agcagggtt

SEQ ID NO: 1452 - DNA, 9 bp, Artificial Sequence
  Synthetic nucleic acid molecule
agcatagtc

SEQ ID NO: 1453 - DNA, 9 bp, Artificial Sequence
  Synthetic nucleic acid molecule
agcagcaac

SEQ ID NO: 1454 - DNA, 9 bp, Artificial Sequence
  Synthetic nucleic acid molecule
agctacgtc

SEQ ID NO: 1455 - DNA, 9 bp, Artificial Sequence
  Synthetic nucleic acid molecule
agcagcatt

SEQ ID NO: 1456 - DNA, 9 bp, Artificial Sequence
  Synthetic nucleic acid molecule
agcattgtc

SEQ ID NO: 1457 - DNA, 9 bp, Artificial Sequence
  Synthetic nucleic acid molecule
agcagcacc

SEQ ID NO: 1458 - DNA, 9 bp, Artificial Sequence
  Synthetic nucleic acid molecule
agcagggtt

SEQ ID NO: 1459 - DNA, 9 bp, Artificial Sequence
  Synthetic nucleic acid molecule
agtagagtc

SEQ ID NO: 1460 - DNA, 9 bp, Artificial Sequence
  Synthetic nucleic acid molecule
agcaacgtg

SEQ ID NO: 1461 - DNA, 9 bp, Artificial Sequence
  Synthetic nucleic acid molecule
agcaaggtc

SEQ ID NO: 1462 - DNA, 9 bp, Artificial Sequence
  Synthetic nucleic acid molecule
agcagccac

SEQ ID NO: 1463 - DNA, 9 bp, Artificial Sequence
  Synthetic nucleic acid molecule
agcaatgtc

SEQ ID NO: 1464 - DNA, 9 bp, Artificial Sequence
  Synthetic nucleic acid molecule
agcagctac

SEQ ID NO: 1465 - DNA, 9 bp, Artificial Sequence
  Synthetic nucleic acid molecule
agcagctgc

SEQ ID NO: 1466 - DNA, 9 bp, Artificial Sequence
  Synthetic nucleic acid molecule
agcaggggc

SEQ ID NO: 1467 - DNA, 9 bp, Artificial Sequence
  Synthetic nucleic acid molecule
agcaacgtg

SEQ ID NO: 1468 - DNA, 9 bp, Artificial Sequence
  Synthetic nucleic acid molecule
aacagcgta

SEQ ID NO: 1469 - DNA, 9 bp, Artificial Sequence
  Synthetic nucleic acid molecule
tgcaccgtc

SEQ ID NO: 1470 - DNA, 9 bp, Artificial Sequence
  Synthetic nucleic acid molecule
agcagtgtg

SEQ ID NO: 1471 - DNA, 9 bp, Artificial Sequence
  Synthetic nucleic acid molecule
agcagctgc

SEQ ID NO: 1472 - DNA, 9 bp, Artificial Sequence
  Synthetic nucleic acid molecule
agcaccttc

SEQ ID NO: 1473 - DNA, 9 bp, Artificial Sequence
  Synthetic nucleic acid molecule
agcaaggtc

SEQ ID NO: 1474 - DNA, 9 bp, Artificial Sequence
  Synthetic nucleic acid molecule
agctgcgtg

SEQ ID NO: 1475 - DNA, 9 bp, Artificial Sequence
  Synthetic nucleic acid molecule
agcaaggtc

SEQ ID NO: 1476 - DNA, 9 bp, Artificial Sequence
  Synthetic nucleic acid molecule
agcagattc

SEQ ID NO: 1477 - DNA, 9 bp, Artificial Sequence
  Synthetic nucleic acid molecule
agcaaagtc

SEQ ID NO: 1478 - DNA, 9 bp, Artificial Sequence
  Synthetic nucleic acid molecule
tgcagggtc

SEQ ID NO: 1479 - DNA, 9 bp, Artificial Sequence
  Synthetic nucleic acid molecule
agcagaatc

SEQ ID NO: 1480 - DNA, 9 bp, Artificial Sequence
  Synthetic nucleic acid molecule
agctgagtc

SEQ ID NO: 1481 - DNA, 9 bp, Artificial Sequence
  Synthetic nucleic acid molecule
agcattgtc

SEQ ID NO: 1482 - DNA, 9 bp, Artificial Sequence
  Synthetic nucleic acid molecule
tgcagggtc

SEQ ID NO: 1483 - DNA, 9 bp, Artificial Sequence
  Synthetic nucleic acid molecule
agcaacttc

SEQ ID NO: 1484 - DNA, 9 bp, Artificial Sequence
  Synthetic nucleic acid molecule
agcagctgc

SEQ ID NO: 1485 - DNA, 9 bp, Artificial Sequence
  Synthetic nucleic acid molecule
agcagggtt

SEQ ID NO: 1486 - DNA, 9 bp, Artificial Sequence
  Synthetic nucleic acid molecule
agcaaggtc

SEQ ID NO: 1487 - DNA, 9 bp, Artificial Sequence
  Synthetic nucleic acid molecule
agctgtgtc

SEQ ID NO: 1488 - DNA, 9 bp, Artificial Sequence
  Synthetic nucleic acid molecule
aacagcatc

SEQ ID NO: 1489 - DNA, 9 bp, Artificial Sequence
  Synthetic nucleic acid molecule
agaagcttc

SEQ ID NO: 1490 - DNA, 9 bp, Artificial Sequence
  Synthetic nucleic acid molecule
agcagagtt

SEQ ID NO: 1491 - DNA, 9 bp, Artificial Sequence
  Synthetic nucleic acid molecule
agcagagtt

SEQ ID NO: 1492 - DNA, 9 bp, Artificial Sequence
  Synthetic nucleic acid molecule
aggagggtc

SEQ ID NO: 1493 - DNA, 9 bp, Artificial Sequence
  Synthetic nucleic acid molecule
agcaacttc

SEQ ID NO: 1494 - DNA, 9 bp, Artificial Sequence
  Synthetic nucleic acid molecule
agcagctcc

SEQ ID NO: 1495 - DNA, 9 bp, Artificial Sequence
  Synthetic nucleic acid molecule
agcaaagtc

SEQ ID NO: 1496 - DNA, 9 bp, Artificial Sequence
  Synthetic nucleic acid molecule
agcaacgtg

SEQ ID NO: 1497 - DNA, 9 bp, Artificial Sequence
  Synthetic nucleic acid molecule
agcagggtg

SEQ ID NO: 1498 - DNA, 9 bp, Artificial Sequence
  Synthetic nucleic acid molecule
agcaggttc

SEQ ID NO: 1499 - DNA, 9 bp, Artificial Sequence
  Synthetic nucleic acid molecule
agcagcttg

SEQ ID NO: 1500 - DNA, 9 bp, Artificial Sequence
  Synthetic nucleic acid molecule
agcagtgtt

SEQ ID NO: 1501 - DNA, 9 bp, Artificial Sequence
  Synthetic nucleic acid molecule
agaggcgtc

SEQ ID NO: 1502 - DNA, 9 bp, Artificial Sequence
  Synthetic nucleic acid molecule
agcagtgac

SEQ ID NO: 1503 - DNA, 9 bp, Artificial Sequence
  Synthetic nucleic acid molecule
agcaccttc

SEQ ID NO: 1504 - DNA, 9 bp, Artificial Sequence
  Synthetic nucleic acid molecule
atcagtgtc

SEQ ID NO: 1505 - DNA, 9 bp, Artificial Sequence
  Synthetic nucleic acid molecule
agcagcagc

SEQ ID NO: 1506 - DNA, 9 bp, Artificial Sequence
  Synthetic nucleic acid molecule
agcagtgac

SEQ ID NO: 1507 - DNA, 9 bp, Artificial Sequence
  Synthetic nucleic acid molecule
agcagggtt

SEQ ID NO: 1508 - DNA, 9 bp, Artificial Sequence
  Synthetic nucleic acid molecule
agctgcggc

SEQ ID NO: 1509 - DNA, 9 bp, Artificial Sequence
  Synthetic nucleic acid molecule
agcaacatc

SEQ ID NO: 1510 - DNA, 9 bp, Artificial Sequence
  Synthetic nucleic acid molecule
agcaacgta

SEQ ID NO: 1511 - DNA, 9 bp, Artificial Sequence
  Synthetic nucleic acid molecule
agcaggatc

SEQ ID NO: 1512 - DNA, 9 bp, Artificial Sequence
  Synthetic nucleic acid molecule
agcagcaac

SEQ ID NO: 1513 - DNA, 9 bp, Artificial Sequence
  Synthetic nucleic acid molecule
agtagcggc

SEQ ID NO: 1514 - DNA, 9 bp, Artificial Sequence
  Synthetic nucleic acid molecule
agcagcccc

SEQ ID NO: 1515 - DNA, 9 bp, Artificial Sequence
  Synthetic nucleic acid molecule
agcagctgc

SEQ ID NO: 1516 - DNA, 9 bp, Artificial Sequence
  Synthetic nucleic acid molecule
agcaccgtt

SEQ ID NO: 1517 - DNA, 9 bp, Artificial Sequence
  Synthetic nucleic acid molecule
agcagggtg

SEQ ID NO: 1518 - DNA, 9 bp, Artificial Sequence
  Synthetic nucleic acid molecule
agctgggtc

SEQ ID NO: 1519 - DNA, 9 bp, Artificial Sequence
  Synthetic nucleic acid molecule
accaccgtc

SEQ ID NO: 1520 - DNA, 9 bp, Artificial Sequence
  Synthetic nucleic acid molecule
agaagcttc

SEQ ID NO: 1521 - DNA, 9 bp, Artificial Sequence
  Synthetic nucleic acid molecule
agcagaggc

SEQ ID NO: 1522 - DNA, 9 bp, Artificial Sequence
  Synthetic nucleic acid molecule
agcatcgtt

SEQ ID NO: 1523 - DNA, 9 bp, Artificial Sequence
  Synthetic nucleic acid molecule
agaagcgtg

SEQ ID NO: 1524 - DNA, 9 bp, Artificial Sequence
  Synthetic nucleic acid molecule
gacagcgtc

SEQ ID NO: 1525 - DNA, 9 bp, Artificial Sequence
  Synthetic nucleic acid molecule
agcagagac

SEQ ID NO: 1526 - DNA, 9 bp, Artificial Sequence
  Synthetic nucleic acid molecule
agcaaagtc

SEQ ID NO: 1527 - DNA, 9 bp, Artificial Sequence
  Synthetic nucleic acid molecule
agcattgtc

SEQ ID NO: 1528 - DNA, 9 bp, Artificial Sequence
  Synthetic nucleic acid molecule
agcaaagtc

SEQ ID NO: 1529 - DNA, 9 bp, Artificial Sequence
  Synthetic nucleic acid molecule
agcacagtc

SEQ ID NO: 1530 - DNA, 9 bp, Artificial Sequence
  Synthetic nucleic acid molecule
agcagcagc

SEQ ID NO: 1531 - DNA, 9 bp, Artificial Sequence
  Synthetic nucleic acid molecule
agcagggtg

SEQ ID NO: 1532 - DNA, 9 bp, Artificial Sequence
  Synthetic nucleic acid molecule
aggagcatc

SEQ ID NO: 1533 - DNA, 9 bp, Artificial Sequence
  Synthetic nucleic acid molecule
agctgggtc

SEQ ID NO: 1534 - DNA, 9 bp, Artificial Sequence
  Synthetic nucleic acid molecule
agctgtgtc

SEQ ID NO: 1535 - DNA, 9 bp, Artificial Sequence
  Synthetic nucleic acid molecule
agctgtgtc

SEQ ID NO: 1536 - DNA, 9 bp, Artificial Sequence
  Synthetic nucleic acid molecule
aggagcgta

SEQ ID NO: 1537 - DNA, 9 bp, Artificial Sequence
  Synthetic nucleic acid molecule
agcagccac

SEQ ID NO: 1538 - DNA, 9 bp, Artificial Sequence
  Synthetic nucleic acid molecule
agcagcatg

SEQ ID NO: 1539 - DNA, 9 bp, Artificial Sequence
  Synthetic nucleic acid molecule
agcattgtc

SEQ ID NO: 1540 - DNA, 9 bp, Artificial Sequence
  Synthetic nucleic acid molecule
agcagcctg

SEQ ID NO: 1541 - DNA, 9 bp, Artificial Sequence
  Synthetic nucleic acid molecule
agcagctcc

SEQ ID NO: 1542 - DNA, 9 bp, Artificial Sequence
  Synthetic nucleic acid molecule
agcagcagc

SEQ ID NO: 1543 - DNA, 9 bp, Artificial Sequence
  Synthetic nucleic acid molecule
agcaacttc

SEQ ID NO: 1544 - DNA, 9 bp, Artificial Sequence
  Synthetic nucleic acid molecule
agcagagta

SEQ ID NO: 1545 - DNA, 9 bp, Artificial Sequence
  Synthetic nucleic acid molecule
agcagcctt

SEQ ID NO: 1546 - DNA, 9 bp, Artificial Sequence
  Synthetic nucleic acid molecule
agcagtgtt

SEQ ID NO: 1547 - DNA, 9 bp, Artificial Sequence
  Synthetic nucleic acid molecule
agaagcatc

SEQ ID NO: 1548 - DNA, 9 bp, Artificial Sequence
  Synthetic nucleic acid molecule
agcagggta

SEQ ID NO: 1549 - DNA, 9 bp, Artificial Sequence
  Synthetic nucleic acid molecule
agcagagtt

SEQ ID NO: 1550 - DNA, 9 bp, Artificial Sequence
  Synthetic nucleic acid molecule
agcagaggc

SEQ ID NO: 1551 - DNA, 9 bp, Artificial Sequence
  Synthetic nucleic acid molecule
agcaacatc

SEQ ID NO: 1552 - DNA, 9 bp, Artificial Sequence
  Synthetic nucleic acid molecule
agcagagta

SEQ ID NO: 1553 - DNA, 9 bp, Artificial Sequence
  Synthetic nucleic acid molecule
agcatcgtt

SEQ ID NO: 1554 - DNA, 9 bp, Artificial Sequence
  Synthetic nucleic acid molecule
agaagcttc

SEQ ID NO: 1555 - DNA, 9 bp, Artificial Sequence
  Synthetic nucleic acid molecule
atcagcggc

SEQ ID NO: 1556 - DNA, 9 bp, Artificial Sequence
  Synthetic nucleic acid molecule
agcagaatc

SEQ ID NO: 1557 - DNA, 9 bp, Artificial Sequence
  Synthetic nucleic acid molecule
agctacgtc

SEQ ID NO: 1558 - DNA, 9 bp, Artificial Sequence
  Synthetic nucleic acid molecule
agcaatgtc

SEQ ID NO: 1559 - DNA, 9 bp, Artificial Sequence
  Synthetic nucleic acid molecule
agcattgtc

SEQ ID NO: 1560 - DNA, 9 bp, Artificial Sequence
  Synthetic nucleic acid molecule
agcaccgcc

SEQ ID NO: 1561 - DNA, 9 bp, Artificial Sequence
  Synthetic nucleic acid molecule
agcacggtc

SEQ ID NO: 1562 - DNA, 9 bp, Artificial Sequence
  Synthetic nucleic acid molecule
agcaacatc

SEQ ID NO: 1563 - DNA, 9 bp, Artificial Sequence
  Synthetic nucleic acid molecule
agcagggtt

SEQ ID NO: 1564 - DNA, 9 bp, Artificial Sequence
  Synthetic nucleic acid molecule
agcagctgc

SEQ ID NO: 1565 - DNA, 9 bp, Artificial Sequence
  Synthetic nucleic acid molecule
agcagtgtg

SEQ ID NO: 1566 - DNA, 9 bp, Artificial Sequence
  Synthetic nucleic acid molecule
aacagagtc

SEQ ID NO: 1567 - DNA, 9 bp, Artificial Sequence
  Synthetic nucleic acid molecule
ggcagtgtc

SEQ ID NO: 1568 - DNA, 9 bp, Artificial Sequence
  Synthetic nucleic acid molecule
agcagtgtg

SEQ ID NO: 1569 - DNA, 9 bp, Artificial Sequence
  Synthetic nucleic acid molecule
agcaaggtc

SEQ ID NO: 1570 - DNA, 9 bp, Artificial Sequence
  Synthetic nucleic acid molecule
agcagtgtg

SEQ ID NO: 1571 - DNA, 9 bp, Artificial Sequence
  Synthetic nucleic acid molecule
agcagtgtg

SEQ ID NO: 1572 - DNA, 9 bp, Artificial Sequence
  Synthetic nucleic acid molecule
agcagtgtg

SEQ ID NO: 1573 - DNA, 9 bp, Artificial Sequence
  Synthetic nucleic acid molecule
agcagtgtg

SEQ ID NO: 1574 - DNA, 9 bp, Artificial Sequence
  Synthetic nucleic acid molecule
agcagtgtg

SEQ ID NO: 1575 - DNA, 9 bp, Artificial Sequence
  Synthetic nucleic acid molecule
agcagcatg

SEQ ID NO: 1576 - DNA, 9 bp, Artificial Sequence
  Synthetic nucleic acid molecule
agcactgtc

SEQ ID NO: 1577 - DNA, 9 bp, Artificial Sequence
  Synthetic nucleic acid molecule
ggcagtgtc

SEQ ID NO: 1578 - DNA, 9 bp, Artificial Sequence
  Synthetic nucleic acid molecule
cacagcgtc

SEQ ID NO: 1579 - DNA, 9 bp, Artificial Sequence
  Synthetic nucleic acid molecule
agcaccttc

SEQ ID NO: 1580 - DNA, 9 bp, Artificial Sequence
  Synthetic nucleic acid molecule
agcacagtc

SEQ ID NO: 1581 - DNA, 9 bp, Artificial Sequence
  Synthetic nucleic acid molecule
agcagattc

SEQ ID NO: 1582 - DNA, 9 bp, Artificial Sequence
  Synthetic nucleic acid molecule
aggagggtc

SEQ ID NO: 1583 - DNA, 9 bp, Artificial Sequence
  Synthetic nucleic acid molecule
agcaacgtg

SEQ ID NO: 1584 - DNA, 9 bp, Artificial Sequence
  Synthetic nucleic acid molecule
agcggcgtt

SEQ ID NO: 1585 - DNA, 9 bp, Artificial Sequence
  Synthetic nucleic acid molecule
aggagtgtc

SEQ ID NO: 1586 - DNA, 9 bp, Artificial Sequence
  Synthetic nucleic acid molecule
agctgcttc

SEQ ID NO: 1587 - DNA, 9 bp, Artificial Sequence
  Synthetic nucleic acid molecule
agcaacatc

SEQ ID NO: 1588 - DNA, 9 bp, Artificial Sequence
  Synthetic nucleic acid molecule
agcatagtc

SEQ ID NO: 1589 - DNA, 9 bp, Artificial Sequence
  Synthetic nucleic acid molecule
agcaacatc

SEQ ID NO: 1590 - DNA, 9 bp, Artificial Sequence
  Synthetic nucleic acid molecule
ggcagcgcc

SEQ ID NO: 1591 - DNA, 9 bp, Artificial Sequence
  Synthetic nucleic acid molecule
agcagagtg

SEQ ID NO: 1592 - DNA, 9 bp, Artificial Sequence
  Synthetic nucleic acid molecule
agcaaagtc

SEQ ID NO: 1593 - DNA, 9 bp, Artificial Sequence
  Synthetic nucleic acid molecule
gacagcgtc

SEQ ID NO: 1594 - DNA, 9 bp, Artificial Sequence
  Synthetic nucleic acid molecule
agcggcggc

SEQ ID NO: 1595 - DNA, 9 bp, Artificial Sequence
  Synthetic nucleic acid molecule
agccgcatc

SEQ ID NO: 1596 - DNA, 9 bp, Artificial Sequence
  Synthetic nucleic acid molecule
agcaaagtc

SEQ ID NO: 1597 - DNA, 9 bp, Artificial Sequence
  Synthetic nucleic acid molecule
agcaggttc

SEQ ID NO: 1598 - DNA, 9 bp, Artificial Sequence
  Synthetic nucleic acid molecule
agctgggtc

SEQ ID NO: 1599 - DNA, 9 bp, Artificial Sequence
  Synthetic nucleic acid molecule
agcagagac

SEQ ID NO: 1600 - DNA, 9 bp, Artificial Sequence
  Synthetic nucleic acid molecule
agcagaggc

SEQ ID NO: 1601 - DNA, 9 bp, Artificial Sequence
  Synthetic nucleic acid molecule
agctgagtc

SEQ ID NO: 1602 - DNA, 9 bp, Artificial Sequence
  Synthetic nucleic acid molecule
agtagagtc

SEQ ID NO: 1603 - DNA, 9 bp, Artificial Sequence
  Synthetic nucleic acid molecule
tgcagcgac

SEQ ID NO: 1604 - DNA, 9 bp, Artificial Sequence
  Synthetic nucleic acid molecule
agcagctgc

SEQ ID NO: 1605 - DNA, 9 bp, Artificial Sequence
  Synthetic nucleic acid molecule
agcagcatg

SEQ ID NO: 1606 - DNA, 9 bp, Artificial Sequence
  Synthetic nucleic acid molecule
agctgagtc

SEQ ID NO: 1607 - DNA, 9 bp, Artificial Sequence
  Synthetic nucleic acid molecule
agcaacatc

SEQ ID NO: 1608 - DNA, 9 bp, Artificial Sequence
  Synthetic nucleic acid molecule
agcaacatc

SEQ ID NO: 1609 - DNA, 9 bp, Artificial Sequence
  Synthetic nucleic acid molecule
accagcttc

SEQ ID NO: 1610 - DNA, 9 bp, Artificial Sequence
  Synthetic nucleic acid molecule
agcagcatt

SEQ ID NO: 1611 - DNA, 9 bp, Artificial Sequence
  Synthetic nucleic acid molecule
aggagtgtc

SEQ ID NO: 1612 - DNA, 9 bp, Artificial Sequence
  Synthetic nucleic acid molecule
agaagcggc

SEQ ID NO: 1613 - DNA, 9 bp, Artificial Sequence
  Synthetic nucleic acid molecule
agcagccac

SEQ ID NO: 1614 - DNA, 9 bp, Artificial Sequence
  Synthetic nucleic acid molecule
agcagcagc

SEQ ID NO: 1615 - DNA, 9 bp, Artificial Sequence
  Synthetic nucleic acid molecule
agcacagtc

SEQ ID NO: 1616 - DNA, 9 bp, Artificial Sequence
  Synthetic nucleic acid molecule
agctgcggc

SEQ ID NO: 1617 - DNA, 9 bp, Artificial Sequence
  Synthetic nucleic acid molecule
agcaaggtc

SEQ ID NO: 1618 - DNA, 9 bp, Artificial Sequence
  Synthetic nucleic acid molecule
agcaccttc

SEQ ID NO: 1619 - DNA, 9 bp, Artificial Sequence
  Synthetic nucleic acid molecule
agcagcatg

SEQ ID NO: 1620 - DNA, 9 bp, Artificial Sequence
  Synthetic nucleic acid molecule
agcaaggtc

SEQ ID NO: 1621 - DNA, 9 bp, Artificial Sequence
  Synthetic nucleic acid molecule
agcatggtc

SEQ ID NO: 1622 - DNA, 9 bp, Artificial Sequence
  Synthetic nucleic acid molecule
agcagcatg

SEQ ID NO: 1623 - DNA, 9 bp, Artificial Sequence
  Synthetic nucleic acid molecule
agcagggtg

SEQ ID NO: 1624 - DNA, 9 bp, Artificial Sequence
  Synthetic nucleic acid molecule
agaggtgtc

SEQ ID NO: 1625 - DNA, 9 bp, Artificial Sequence
  Synthetic nucleic acid molecule
gtcagggtc

SEQ ID NO: 1626 - DNA, 9 bp, Artificial Sequence
  Synthetic nucleic acid molecule
tgcactgtc

SEQ ID NO: 1627 - DNA, 9 bp, Artificial Sequence
  Synthetic nucleic acid molecule
tgcggagtc

SEQ ID NO: 1628 - DNA, 9 bp, Artificial Sequence
  Synthetic nucleic acid molecule
agaaacgtt

SEQ ID NO: 1629 - DNA, 9 bp, Artificial Sequence
  Synthetic nucleic acid molecule
aggagcaac

SEQ ID NO: 1630 - DNA, 9 bp, Artificial Sequence
  Synthetic nucleic acid molecule
cgctgtgtc

SEQ ID NO: 1631 - DNA, 9 bp, Artificial Sequence
  Synthetic nucleic acid molecule
agcgtggtc

SEQ ID NO: 1632 - DNA, 9 bp, Artificial Sequence
  Synthetic nucleic acid molecule
agcaggtcc

SEQ ID NO: 1633 - DNA, 9 bp, Artificial Sequence
  Synthetic nucleic acid molecule
ggctgtgtc

SEQ ID NO: 1634 - DNA, 9 bp, Artificial Sequence
  Synthetic nucleic acid molecule
tgcagagtt

SEQ ID NO: 1635 - DNA, 9 bp, Artificial Sequence
  Synthetic nucleic acid molecule
atcatggtc

SEQ ID NO: 1636 - DNA, 9 bp, Artificial Sequence
  Synthetic nucleic acid molecule
agcaacgcg

SEQ ID NO: 1637 - DNA, 9 bp, Artificial Sequence
  Synthetic nucleic acid molecule
tgaagtgtc

SEQ ID NO: 1638 - DNA, 9 bp, Artificial Sequence
  Synthetic nucleic acid molecule
agcaactcc

SEQ ID NO: 1639 - DNA, 9 bp, Artificial Sequence
  Synthetic nucleic acid molecule
agaaatgtc

SEQ ID NO: 1640 - DNA, 9 bp, Artificial Sequence
  Synthetic nucleic acid molecule
ggcagggta

SEQ ID NO: 1641 - DNA, 9 bp, Artificial Sequence
  Synthetic nucleic acid molecule
agcaacatg

SEQ ID NO: 1642 - DNA, 9 bp, Artificial Sequence
  Synthetic nucleic acid molecule
gacagcgtg

SEQ ID NO: 1643 - DNA, 9 bp, Artificial Sequence
  Synthetic nucleic acid molecule
ggctgagtc

SEQ ID NO: 1644 - DNA, 9 bp, Artificial Sequence
  Synthetic nucleic acid molecule
tgcagagtt

SEQ ID NO: 1645 - DNA, 9 bp, Artificial Sequence
  Synthetic nucleic acid molecule
agctgagtg

SEQ ID NO: 1646 - DNA, 9 bp, Artificial Sequence
  Synthetic nucleic acid molecule
aactgagtc

SEQ ID NO: 1647 - DNA, 9 bp, Artificial Sequence
  Synthetic nucleic acid molecule
aacatagtc

SEQ ID NO: 1648 - DNA, 9 bp, Artificial Sequence
  Synthetic nucleic acid molecule
agctgggtg

SEQ ID NO: 1649 - DNA, 9 bp, Artificial Sequence
  Synthetic nucleic acid molecule
agcaccata

SEQ ID NO: 1650 - DNA, 9 bp, Artificial Sequence
  Synthetic nucleic acid molecule
atcaggttc

SEQ ID NO: 1651 - DNA, 9 bp, Artificial Sequence
  Synthetic nucleic acid molecule
accacggtc

SEQ ID NO: 1652 - DNA, 9 bp, Artificial Sequence
  Synthetic nucleic acid molecule
accacggtc

SEQ ID NO: 1653 - DNA, 9 bp, Artificial Sequence
  Synthetic nucleic acid molecule
accacggtc

SEQ ID NO: 1654 - DNA, 9 bp, Artificial Sequence
  Synthetic nucleic acid molecule
accacggtc

SEQ ID NO: 1655 - DNA, 9 bp, Artificial Sequence
  Synthetic nucleic acid molecule
accatggtc

SEQ ID NO: 1656 - DNA, 9 bp, Artificial Sequence
  Synthetic nucleic acid molecule
agaaacttc

SEQ ID NO: 1657 - DNA, 9 bp, Artificial Sequence
  Synthetic nucleic acid molecule
cacagcttc

SEQ ID NO: 1658 - DNA, 9 bp, Artificial Sequence
  Synthetic nucleic acid molecule
atcatggtc

SEQ ID NO: 1659 - DNA, 9 bp, Artificial Sequence
  Synthetic nucleic acid molecule
agcagtgat

SEQ ID NO: 1660 - DNA, 9 bp, Artificial Sequence
  Synthetic nucleic acid molecule
accaaggtc

SEQ ID NO: 1661 - DNA, 9 bp, Artificial Sequence
  Synthetic nucleic acid molecule
agccccttc

SEQ ID NO: 1662 - DNA, 9 bp, Artificial Sequence
  Synthetic nucleic acid molecule
ctcagtgtc

SEQ ID NO: 1663 - DNA, 9 bp, Artificial Sequence
  Synthetic nucleic acid molecule
agttgcttc

SEQ ID NO: 1664 - DNA, 9 bp, Artificial Sequence
  Synthetic nucleic acid molecule
aagagagtc

SEQ ID NO: 1665 - DNA, 9 bp, Artificial Sequence
  Synthetic nucleic acid molecule
ggcagtgtg

SEQ ID NO: 1666 - DNA, 9 bp, Artificial Sequence
  Synthetic nucleic acid molecule
tgcagagtt

SEQ ID NO: 1667 - DNA, 9 bp, Artificial Sequence
  Synthetic nucleic acid molecule
agcctcgtt

SEQ ID NO: 1668 - DNA, 9 bp, Artificial Sequence
  Synthetic nucleic acid molecule
atcatcttc

SEQ ID NO: 1669 - DNA, 9 bp, Artificial Sequence
  Synthetic nucleic acid molecule
agtagtgtg

SEQ ID NO: 1670 - DNA, 9 bp, Artificial Sequence
  Synthetic nucleic acid molecule
agcctcgtg

SEQ ID NO: 1671 - DNA, 9 bp, Artificial Sequence
  Synthetic nucleic acid molecule
aaaagcgtt

SEQ ID NO: 1672 - DNA, 9 bp, Artificial Sequence
  Synthetic nucleic acid molecule
actagagtc

SEQ ID NO: 1673 - DNA, 9 bp, Artificial Sequence
  Synthetic nucleic acid molecule
ggcggcggc

SEQ ID NO: 1674 - DNA, 9 bp, Artificial Sequence
  Synthetic nucleic acid molecule
atgagagtc

SEQ ID NO: 1675 - DNA, 9 bp, Artificial Sequence
  Synthetic nucleic acid molecule
agcacagtg

SEQ ID NO: 1676 - DNA, 9 bp, Artificial Sequence
  Synthetic nucleic acid molecule
tacagggtc

SEQ ID NO: 1677 - DNA, 9 bp, Artificial Sequence
  Synthetic nucleic acid molecule
agcagaggt

SEQ ID NO: 1678 - DNA, 9 bp, Artificial Sequence
  Synthetic nucleic acid molecule
ggaagagtc

SEQ ID NO: 1679 - DNA, 9 bp, Artificial Sequence
  Synthetic nucleic acid molecule
ggaagagtc

SEQ ID NO: 1680 - DNA, 9 bp, Artificial Sequence
  Synthetic nucleic acid molecule
agtggggtc

SEQ ID NO: 1681 - DNA, 9 bp, Artificial Sequence
  Synthetic nucleic acid molecule
atgagggtc

SEQ ID NO: 1682 - DNA, 9 bp, Artificial Sequence
  Synthetic nucleic acid molecule
gtcagagtc

SEQ ID NO: 1683 - DNA, 9 bp, Artificial Sequence
  Synthetic nucleic acid molecule
gccagggtc

SEQ ID NO: 1684 - DNA, 9 bp, Artificial Sequence
  Synthetic nucleic acid molecule
agcaactcc

SEQ ID NO: 1685 - DNA, 9 bp, Artificial Sequence
  Synthetic nucleic acid molecule
aggggagtc

SEQ ID NO: 1686 - DNA, 9 bp, Artificial Sequence
  Synthetic nucleic acid molecule
gtcagggtc

SEQ ID NO: 1687 - DNA, 9 bp, Artificial Sequence
  Synthetic nucleic acid molecule
gtcagggtc

SEQ ID NO: 1688 - DNA, 9 bp, Artificial Sequence
  Synthetic nucleic acid molecule
agcatagta

SEQ ID NO: 1689 - DNA, 9 bp, Artificial Sequence
  Synthetic nucleic acid molecule
gtcagagtc

SEQ ID NO: 1690 - DNA, 9 bp, Artificial Sequence
  Synthetic nucleic acid molecule
ggcagtgtt

SEQ ID NO: 1691 - DNA, 9 bp, Artificial Sequence
  Synthetic nucleic acid molecule
gccatcgtc

SEQ ID NO: 1692 - DNA, 9 bp, Artificial Sequence
  Synthetic nucleic acid molecule
ctcagtgtc

SEQ ID NO: 1693 - DNA, 9 bp, Artificial Sequence
  Synthetic nucleic acid molecule
ggaagagtc

SEQ ID NO: 1694 - DNA, 9 bp, Artificial Sequence
  Synthetic nucleic acid molecule
agcaactcc

SEQ ID NO: 1695 - DNA, 9 bp, Artificial Sequence
  Synthetic nucleic acid molecule
agcctcggc

SEQ ID NO: 1696 - DNA, 9 bp, Artificial Sequence
  Synthetic nucleic acid molecule
gacagggtc

SEQ ID NO: 1697 - DNA, 9 bp, Artificial Sequence
  Synthetic nucleic acid molecule
agaatagtc

SEQ ID NO: 1698 - DNA, 9 bp, Artificial Sequence
  Synthetic nucleic acid molecule
agtagagta

SEQ ID NO: 1699 - DNA, 9 bp, Artificial Sequence
  Synthetic nucleic acid molecule
gggagggtc

SEQ ID NO: 1700 - DNA, 9 bp, Artificial Sequence
  Synthetic nucleic acid molecule
aacagggtt

SEQ ID NO: 1701 - DNA, 9 bp, Artificial Sequence
  Synthetic nucleic acid molecule
gccagggtc

SEQ ID NO: 1702 - DNA, 9 bp, Artificial Sequence
  Synthetic nucleic acid molecule
ggaagagtc

SEQ ID NO: 1703 - DNA, 9 bp, Artificial Sequence
  Synthetic nucleic acid molecule
agtggagtc

SEQ ID NO: 1704 - DNA, 9 bp, Artificial Sequence
  Synthetic nucleic acid molecule
gccagagtc

SEQ ID NO: 1705 - DNA, 9 bp, Artificial Sequence
  Synthetic nucleic acid molecule
ggcagtgta

SEQ ID NO: 1706 - DNA, 9 bp, Artificial Sequence
  Synthetic nucleic acid molecule
ctcagtgtc

SEQ ID NO: 1707 - DNA, 9 bp, Artificial Sequence
  Synthetic nucleic acid molecule
agatgggtc

SEQ ID NO: 1708 - DNA, 9 bp, Artificial Sequence
  Synthetic nucleic acid molecule
gccagagtc

SEQ ID NO: 1709 - DNA, 9 bp, Artificial Sequence
  Synthetic nucleic acid molecule
agtagggtt

SEQ ID NO: 1710 - DNA, 9 bp, Artificial Sequence
  Synthetic nucleic acid molecule
cactgcgtc

SEQ ID NO: 1711 - DNA, 9 bp, Artificial Sequence
  Synthetic nucleic acid molecule
aactgggtc

SEQ ID NO: 1712 - DNA, 9 bp, Artificial Sequence
  Synthetic nucleic acid molecule
agtaacatc

SEQ ID NO: 1713 - DNA, 9 bp, Artificial Sequence
  Synthetic nucleic acid molecule
gacagagtc

SEQ ID NO: 1714 - DNA, 9 bp, Artificial Sequence
  Synthetic nucleic acid molecule
atcaggttc

SEQ ID NO: 1715 - DNA, 9 bp, Artificial Sequence
  Synthetic nucleic acid molecule
agcatggta

SEQ ID NO: 1716 - DNA, 9 bp, Artificial Sequence
  Synthetic nucleic acid molecule
agcaactgc

SEQ ID NO: 1717 - DNA, 9 bp, Artificial Sequence
  Synthetic nucleic acid molecule
ggctgagtc

SEQ ID NO: 1718 - DNA, 9 bp, Artificial Sequence
  Synthetic nucleic acid molecule
agcagccca

SEQ ID NO: 1719 - DNA, 9 bp, Artificial Sequence
  Synthetic nucleic acid molecule
agcaaagtg

SEQ ID NO: 1720 - DNA, 9 bp, Artificial Sequence
  Synthetic nucleic acid molecule
agaaaagtc

SEQ ID NO: 1721 - DNA, 9 bp, Artificial Sequence
  Synthetic nucleic acid molecule
aacaacttc

SEQ ID NO: 1722 - DNA, 9 bp, Artificial Sequence
  Synthetic nucleic acid molecule
tgcggagtc

SEQ ID NO: 1723 - DNA, 9 bp, Artificial Sequence
  Synthetic nucleic acid molecule
agaatggtc

SEQ ID NO: 1724 - DNA, 9 bp, Artificial Sequence
  Synthetic nucleic acid molecule
agcagcaga

SEQ ID NO: 1725 - DNA, 9 bp, Artificial Sequence
  Synthetic nucleic acid molecule
agcagcaga

SEQ ID NO: 1726 - DNA, 9 bp, Artificial Sequence
  Synthetic nucleic acid molecule
agttgcttc

SEQ ID NO: 1727 - DNA, 9 bp, Artificial Sequence
  Synthetic nucleic acid molecule
gacagggtc

SEQ ID NO: 1728 - DNA, 9 bp, Artificial Sequence
  Synthetic nucleic acid molecule
ggaagagtc

SEQ ID NO: 1729 - DNA, 9 bp, Artificial Sequence
  Synthetic nucleic acid molecule
ggaagagtc

SEQ ID NO: 1730 - DNA, 9 bp, Artificial Sequence
  Synthetic nucleic acid molecule
aggggggtc

SEQ ID NO: 1731 - DNA, 9 bp, Artificial Sequence
  Synthetic nucleic acid molecule
aacaacttc

SEQ ID NO: 1732 - DNA, 9 bp, Artificial Sequence
  Synthetic nucleic acid molecule
accaaggtc

SEQ ID NO: 1733 - DNA, 9 bp, Artificial Sequence
  Synthetic nucleic acid molecule
ggccacgtc

SEQ ID NO: 1734 - DNA, 9 bp, Artificial Sequence
  Synthetic nucleic acid molecule
agcaaggtt

SEQ ID NO: 1735 - DNA, 9 bp, Artificial Sequence
  Synthetic nucleic acid molecule
agtagggtt

SEQ ID NO: 1736 - DNA, 9 bp, Artificial Sequence
  Synthetic nucleic acid molecule
agcagcgtc

SEQ ID NO: 1737 - DNA, 9 bp, Artificial Sequence
  Synthetic nucleic acid molecule
agcagcgtc

SEQ ID NO: 1738 - DNA, 9 bp, Artificial Sequence
  Synthetic nucleic acid molecule
agcagcgtc

SEQ ID NO: 1739 - DNA, 9 bp, Artificial Sequence
  Synthetic nucleic acid molecule
agcagcggc

SEQ ID NO: 1740 - DNA, 9 bp, Artificial Sequence
  Synthetic nucleic acid molecule
agcagcgtt

SEQ ID NO: 1741 - DNA, 9 bp, Artificial Sequence
  Synthetic nucleic acid molecule
agcaacgtc

SEQ ID NO: 1742 - DNA, 9 bp, Artificial Sequence
  Synthetic nucleic acid molecule
agcagcggc

SEQ ID NO: 1743 - DNA, 9 bp, Artificial Sequence
  Synthetic nucleic acid molecule
agcaacgtc

SEQ ID NO: 1744 - DNA, 9 bp, Artificial Sequence
  Synthetic nucleic acid molecule
agcaacgtc

SEQ ID NO: 1745 - DNA, 9 bp, Artificial Sequence
  Synthetic nucleic acid molecule
agcagtgtc

SEQ ID NO: 1746 - DNA, 9 bp, Artificial Sequence
  Synthetic nucleic acid molecule
agcagcggc

SEQ ID NO: 1747 - DNA, 9 bp, Artificial Sequence
  Synthetic nucleic acid molecule
agcaacgtc

SEQ ID NO: 1748 - DNA, 9 bp, Artificial Sequence
  Synthetic nucleic acid molecule
agcaacgtc

SEQ ID NO: 1749 - DNA, 9 bp, Artificial Sequence
  Synthetic nucleic acid molecule
atcagcgtc

SEQ ID NO: 1750 - DNA, 9 bp, Artificial Sequence
  Synthetic nucleic acid molecule
agcaacgtc

SEQ ID NO: 1751 - DNA, 9 bp, Artificial Sequence
  Synthetic nucleic acid molecule
agcaacgtc

SEQ ID NO: 1752 - DNA, 9 bp, Artificial Sequence
  Synthetic nucleic acid molecule
agcagtgtc

SEQ ID NO: 1753 - DNA, 9 bp, Artificial Sequence
  Synthetic nucleic acid molecule
agcagcgtt

SEQ ID NO: 1754 - DNA, 9 bp, Artificial Sequence
  Synthetic nucleic acid molecule
agcaacgtc

SEQ ID NO: 1755 - DNA, 9 bp, Artificial Sequence
  Synthetic nucleic acid molecule
agcaccgtc

SEQ ID NO: 1756 - DNA, 9 bp, Artificial Sequence
  Synthetic nucleic acid molecule
agcaacgtc

SEQ ID NO: 1757 - DNA, 9 bp, Artificial Sequence
  Synthetic nucleic acid molecule
agcattgtc

SEQ ID NO: 1758 - DNA, 9 bp, Artificial Sequence
  Synthetic nucleic acid molecule
agcagcgat

SEQ ID NO: 1759 - DNA, 9 bp, Artificial Sequence
  Synthetic nucleic acid molecule
agctgtgtc

SEQ ID NO: 1760 - DNA, 9 bp, Artificial Sequence
  Synthetic nucleic acid molecule
agcatggtc

SEQ ID NO: 1761 - DNA, 9 bp, Artificial Sequence
  Synthetic nucleic acid molecule
agcatggtc

SEQ ID NO: 1762 - DNA, 9 bp, Artificial Sequence
  Synthetic nucleic acid molecule
agcatcttc

SEQ ID NO: 1763 - DNA, 9 bp, Artificial Sequence
  Synthetic nucleic acid molecule
agcatggtc

SEQ ID NO: 1764 - DNA, 9 bp, Artificial Sequence
  Synthetic nucleic acid molecule
agcatagtc

SEQ ID NO: 1765 - DNA, 9 bp, Artificial Sequence
  Synthetic nucleic acid molecule
agcatggtc

SEQ ID NO: 1766 - DNA, 9 bp, Artificial Sequence
  Synthetic nucleic acid molecule
agcatggtc

SEQ ID NO: 1767 - DNA, 9 bp, Artificial Sequence
  Synthetic nucleic acid molecule
agcatagtc

SEQ ID NO: 1768 - DNA, 9 bp, Artificial Sequence
  Synthetic nucleic acid molecule
agcaaagtc

SEQ ID NO: 1769 - DNA, 9 bp, Artificial Sequence
  Synthetic nucleic acid molecule
agcagcgca

SEQ ID NO: 1770 - DNA, 9 bp, Artificial Sequence
  Synthetic nucleic acid molecule
atcaacgtc

SEQ ID NO: 1771 - DNA, 9 bp, Artificial Sequence
  Synthetic nucleic acid molecule
agtagtgtc

SEQ ID NO: 1772 - DNA, 9 bp, Artificial Sequence
  Synthetic nucleic acid molecule
agcaaagtc

SEQ ID NO: 1773 - DNA, 9 bp, Artificial Sequence
  Synthetic nucleic acid molecule
agccacgtc

SEQ ID NO: 1774 - DNA, 9 bp, Artificial Sequence
  Synthetic nucleic acid molecule
agcatggtc

SEQ ID NO: 1775 - DNA, 9 bp, Artificial Sequence
  Synthetic nucleic acid molecule
agcagagtt

SEQ ID NO: 1776 - DNA, 9 bp, Artificial Sequence
  Synthetic nucleic acid molecule
agcattgtc

SEQ ID NO: 1777 - DNA, 9 bp, Artificial Sequence
  Synthetic nucleic acid molecule
agcatggtc

SEQ ID NO: 1778 - DNA, 9 bp, Artificial Sequence
  Synthetic nucleic acid molecule
agcatggtc

SEQ ID NO: 1779 - DNA, 9 bp, Artificial Sequence
  Synthetic nucleic acid molecule
agcatggtc

SEQ ID NO: 1780 - DNA, 9 bp, Artificial Sequence
  Synthetic nucleic acid molecule
agctgtgtc

SEQ ID NO: 1781 - DNA, 9 bp, Artificial Sequence
  Synthetic nucleic acid molecule
agtagagtc

SEQ ID NO: 1782 - DNA, 9 bp, Artificial Sequence
  Synthetic nucleic acid molecule
agcatggtc

SEQ ID NO: 1783 - DNA, 9 bp, Artificial Sequence
  Synthetic nucleic acid molecule
agctgtgtc

SEQ ID NO: 1784 - DNA, 9 bp, Artificial Sequence
  Synthetic nucleic acid molecule
agcaacttc

SEQ ID NO: 1785 - DNA, 9 bp, Artificial Sequence
  Synthetic nucleic acid molecule
agctgagtc

SEQ ID NO: 1786 - DNA, 9 bp, Artificial Sequence
  Synthetic nucleic acid molecule
agtagggtc

SEQ ID NO: 1787 - DNA, 9 bp, Artificial Sequence
  Synthetic nucleic acid molecule
agctgtgtc

SEQ ID NO: 1788 - DNA, 9 bp, Artificial Sequence
  Synthetic nucleic acid molecule
agcaacatc

SEQ ID NO: 1789 - DNA, 9 bp, Artificial Sequence
  Synthetic nucleic acid molecule
agcatcgtg

SEQ ID NO: 1790 - DNA, 9 bp, Artificial Sequence
  Synthetic nucleic acid molecule
agcatggtc

SEQ ID NO: 1791 - DNA, 9 bp, Artificial Sequence
  Synthetic nucleic acid molecule
agcaacttc

SEQ ID NO: 1792 - DNA, 9 bp, Artificial Sequence
  Synthetic nucleic acid molecule
agcatggtc

SEQ ID NO: 1793 - DNA, 9 bp, Artificial Sequence
  Synthetic nucleic acid molecule
agcatggtc

SEQ ID NO: 1794 - DNA, 9 bp, Artificial Sequence
  Synthetic nucleic acid molecule
agcaaggtc

SEQ ID NO: 1795 - DNA, 9 bp, Artificial Sequence
  Synthetic nucleic acid molecule
agcatggtc

SEQ ID NO: 1796 - DNA, 9 bp, Artificial Sequence
  Synthetic nucleic acid molecule
agcagggta

SEQ ID NO: 1797 - DNA, 9 bp, Artificial Sequence
  Synthetic nucleic acid molecule
ggcagagtc

SEQ ID NO: 1798 - DNA, 9 bp, Artificial Sequence
  Synthetic nucleic acid molecule
agtaacgtc

SEQ ID NO: 1799 - DNA, 9 bp, Artificial Sequence
  Synthetic nucleic acid molecule
agcatggtc

SEQ ID NO: 1800 - DNA, 9 bp, Artificial Sequence
  Synthetic nucleic acid molecule
agcagtgtg

SEQ ID NO: 1801 - DNA, 9 bp, Artificial Sequence
  Synthetic nucleic acid molecule
agcaccatc

SEQ ID NO: 1802 - DNA, 9 bp, Artificial Sequence
  Synthetic nucleic acid molecule
agcaacgtg

SEQ ID NO: 1803 - DNA, 9 bp, Artificial Sequence
  Synthetic nucleic acid molecule
agcaacggc

SEQ ID NO: 1804 - DNA, 9 bp, Artificial Sequence
  Synthetic nucleic acid molecule
agtagagtc

SEQ ID NO: 1805 - DNA, 9 bp, Artificial Sequence
  Synthetic nucleic acid molecule
ggcaccgtc

SEQ ID NO: 1806 - DNA, 9 bp, Artificial Sequence
  Synthetic nucleic acid molecule
agcatggtc

SEQ ID NO: 1807 - DNA, 9 bp, Artificial Sequence
  Synthetic nucleic acid molecule
agcatagtc

SEQ ID NO: 1808 - DNA, 9 bp, Artificial Sequence
  Synthetic nucleic acid molecule
agtaacgtc

SEQ ID NO: 1809 - DNA, 9 bp, Artificial Sequence
  Synthetic nucleic acid molecule
agcatagtg

SEQ ID NO: 1810 - DNA, 9 bp, Artificial Sequence
  Synthetic nucleic acid molecule
atcagggtg

SEQ ID NO: 1811 - DNA, 9 bp, Artificial Sequence
  Synthetic nucleic acid molecule
tacagagtc

SEQ ID NO: 1812 - DNA, 9 bp, Artificial Sequence
  Synthetic nucleic acid molecule
atgagggtc

SEQ ID NO: 1813 - DNA, 9 bp, Artificial Sequence
  Synthetic nucleic acid molecule
agcaaattc

SEQ ID NO: 1814 - DNA, 9 bp, Artificial Sequence
  Synthetic nucleic acid molecule
agcaaagtg

SEQ ID NO: 1815 - DNA, 9 bp, Artificial Sequence
  Synthetic nucleic acid molecule
ataagtgtc

SEQ ID NO: 1816 - DNA, 9 bp, Artificial Sequence
  Synthetic nucleic acid molecule
agtagtctc

SEQ ID NO: 1817 - DNA, 9 bp, Artificial Sequence
  Synthetic nucleic acid molecule
cgcagcaac

SEQ ID NO: 1818 - DNA, 9 bp, Artificial Sequence
  Synthetic nucleic acid molecule
agcaatgtg

SEQ ID NO: 1819 - DNA, 9 bp, Artificial Sequence
  Synthetic nucleic acid molecule
accaaagtc

SEQ ID NO: 1820 - DNA, 9 bp, Artificial Sequence
  Synthetic nucleic acid molecule
agtagtgtt

SEQ ID NO: 1821 - DNA, 9 bp, Artificial Sequence
  Synthetic nucleic acid molecule
agcatagtg

SEQ ID NO: 1822 - DNA, 9 bp, Artificial Sequence
  Synthetic nucleic acid molecule
atcaccatc

SEQ ID NO: 1823 - DNA, 9 bp, Artificial Sequence
  Synthetic nucleic acid molecule
agaatcgtt

SEQ ID NO: 1824 - DNA, 9 bp, Artificial Sequence
  Synthetic nucleic acid molecule
agtaacatc

SEQ ID NO: 1825 - DNA, 9 bp, Artificial Sequence
  Synthetic nucleic acid molecule
aggacagtc

SEQ ID NO: 1826 - DNA, 9 bp, Artificial Sequence
  Synthetic nucleic acid molecule
ggcagtgtt

SEQ ID NO: 1827 - DNA, 9 bp, Artificial Sequence
  Synthetic nucleic acid molecule
agttgtgtc

SEQ ID NO: 1828 - DNA, 9 bp, Artificial Sequence
  Synthetic nucleic acid molecule
cccaccgtc

SEQ ID NO: 1829 - DNA, 9 bp, Artificial Sequence
  Synthetic nucleic acid molecule
agtaccggc

SEQ ID NO: 1830 - DNA, 9 bp, Artificial Sequence
  Synthetic nucleic acid molecule
agcaacttt

SEQ ID NO: 1831 - DNA, 9 bp, Artificial Sequence
  Synthetic nucleic acid molecule
agcaagggc

SEQ ID NO: 1832 - DNA, 9 bp, Artificial Sequence
  Synthetic nucleic acid molecule
gtcagggtc

SEQ ID NO: 1833 - DNA, 9 bp, Artificial Sequence
  Synthetic nucleic acid molecule
aggaaagtc

SEQ ID NO: 1834 - DNA, 9 bp, Artificial Sequence
  Synthetic nucleic acid molecule
cacagtgtc

SEQ ID NO: 1835 - DNA, 9 bp, Artificial Sequence
  Synthetic nucleic acid molecule
gtcagtgtc

SEQ ID NO: 1836 - DNA, 9 bp, Artificial Sequence
  Synthetic nucleic acid molecule
atcaccatc

SEQ ID NO: 1837 - DNA, 9 bp, Artificial Sequence
  Synthetic nucleic acid molecule
atcaacatc

SEQ ID NO: 1838 - DNA, 9 bp, Artificial Sequence
  Synthetic nucleic acid molecule
ccgagcgtc

SEQ ID NO: 1839 - DNA, 9 bp, Artificial Sequence
  Synthetic nucleic acid molecule
agcacagtg

SEQ ID NO: 1840 - DNA, 9 bp, Artificial Sequence
  Synthetic nucleic acid molecule
aacattgtc

SEQ ID NO: 1841 - DNA, 9 bp, Artificial Sequence
  Synthetic nucleic acid molecule
aacattgtc

SEQ ID NO: 1842 - DNA, 9 bp, Artificial Sequence
  Synthetic nucleic acid molecule
aacattgtc

SEQ ID NO: 1843 - DNA, 9 bp, Artificial Sequence
  Synthetic nucleic acid molecule
agtaccggc

SEQ ID NO: 1844 - DNA, 9 bp, Artificial Sequence
  Synthetic nucleic acid molecule
agtacagtc

SEQ ID NO: 1845 - DNA, 9 bp, Artificial Sequence
  Synthetic nucleic acid molecule
aacaacatc

SEQ ID NO: 1846 - DNA, 9 bp, Artificial Sequence
  Synthetic nucleic acid molecule
tcccgcgtc

SEQ ID NO: 1847 - DNA, 9 bp, Artificial Sequence
  Synthetic nucleic acid molecule
aggggagtc

SEQ ID NO: 1848 - DNA, 9 bp, Artificial Sequence
  Synthetic nucleic acid molecule
agtagctgc

SEQ ID NO: 1849 - DNA, 9 bp, Artificial Sequence
  Synthetic nucleic acid molecule
ggaagggtc

SEQ ID NO: 1850 - DNA, 9 bp, Artificial Sequence
  Synthetic nucleic acid molecule
ggaagggtc

SEQ ID NO: 1851 - DNA, 9 bp, Artificial Sequence
  Synthetic nucleic acid molecule
ggaagggtc

SEQ ID NO: 1852 - DNA, 9 bp, Artificial Sequence
  Synthetic nucleic acid molecule
ggaagggtc

SEQ ID NO: 1853 - DNA, 9 bp, Artificial Sequence
  Synthetic nucleic acid molecule
ggaagggtc

SEQ ID NO: 1854 - DNA, 9 bp, Artificial Sequence
  Synthetic nucleic acid molecule
ggaagggtc

SEQ ID NO: 1855 - DNA, 9 bp, Artificial Sequence
  Synthetic nucleic acid molecule
ctcagtgtc

SEQ ID NO: 1856 - DNA, 9 bp, Artificial Sequence
  Synthetic nucleic acid molecule
agtaaagtc

SEQ ID NO: 1857 - DNA, 9 bp, Artificial Sequence
  Synthetic nucleic acid molecule
aacggggtc

SEQ ID NO: 1858 - DNA, 9 bp, Artificial Sequence
  Synthetic nucleic acid molecule
gggagggtc

SEQ ID NO: 1859 - DNA, 9 bp, Artificial Sequence
  Synthetic nucleic acid molecule
ggcagggtt

SEQ ID NO: 1860 - DNA, 9 bp, Artificial Sequence
  Synthetic nucleic acid molecule
aggggagtc

SEQ ID NO: 1861 - DNA, 9 bp, Artificial Sequence
  Synthetic nucleic acid molecule
aacaatgtc

SEQ ID NO: 1862 - DNA, 9 bp, Artificial Sequence
  Synthetic nucleic acid molecule
agcttggtc

SEQ ID NO: 1863 - DNA, 9 bp, Artificial Sequence
  Synthetic nucleic acid molecule
atgagggtc

SEQ ID NO: 1864 - DNA, 9 bp, Artificial Sequence
  Synthetic nucleic acid molecule
gccagtgtc

SEQ ID NO: 1865 - DNA, 9 bp, Artificial Sequence
  Synthetic nucleic acid molecule
atcacagtc

SEQ ID NO: 1866 - DNA, 9 bp, Artificial Sequence
  Synthetic nucleic acid molecule
gacagggtc

SEQ ID NO: 1867 - DNA, 9 bp, Artificial Sequence
  Synthetic nucleic acid molecule
agccttgtc

SEQ ID NO: 1868 - DNA, 9 bp, Artificial Sequence
  Synthetic nucleic acid molecule
ggcagcggt

SEQ ID NO: 1869 - DNA, 9 bp, Artificial Sequence
  Synthetic nucleic acid molecule
tccagtgtc

SEQ ID NO: 1870 - DNA, 9 bp, Artificial Sequence
  Synthetic nucleic acid molecule
agcagctgt

SEQ ID NO: 1871 - DNA, 9 bp, Artificial Sequence
  Synthetic nucleic acid molecule
agcagctca

SEQ ID NO: 1872 - DNA, 9 bp, Artificial Sequence
  Synthetic nucleic acid molecule
ggcaacggc

SEQ ID NO: 1873 - DNA, 9 bp, Artificial Sequence
  Synthetic nucleic acid molecule
agctgagtt

SEQ ID NO: 1874 - DNA, 9 bp, Artificial Sequence
  Synthetic nucleic acid molecule
agcagcaca

SEQ ID NO: 1875 - DNA, 9 bp, Artificial Sequence
  Synthetic nucleic acid molecule
agcaacctt

SEQ ID NO: 1876 - DNA, 9 bp, Artificial Sequence
  Synthetic nucleic acid molecule
agcaaattc

SEQ ID NO: 1877 - DNA, 9 bp, Artificial Sequence
  Synthetic nucleic acid molecule
agacgggtc

SEQ ID NO: 1878 - DNA, 9 bp, Artificial Sequence
  Synthetic nucleic acid molecule
gccagagtc

SEQ ID NO: 1879 - DNA, 9 bp, Artificial Sequence
  Synthetic nucleic acid molecule
agcaacagc

SEQ ID NO: 1880 - DNA, 9 bp, Artificial Sequence
  Synthetic nucleic acid molecule
aaccgagtc

SEQ ID NO: 1881 - DNA, 9 bp, Artificial Sequence
  Synthetic nucleic acid molecule
agcagctca

SEQ ID NO: 1882 - DNA, 9 bp, Artificial Sequence
  Synthetic nucleic acid molecule
ggaagggtc

SEQ ID NO: 1883 - DNA, 9 bp, Artificial Sequence
  Synthetic nucleic acid molecule
agaacggtc

SEQ ID NO: 1884 - DNA, 9 bp, Artificial Sequence
  Synthetic nucleic acid molecule
agcaaggta

SEQ ID NO: 1885 - DNA, 9 bp, Artificial Sequence
  Synthetic nucleic acid molecule
agaatggtc

SEQ ID NO: 1886 - DNA, 9 bp, Artificial Sequence
  Synthetic nucleic acid molecule
agaatggtc

SEQ ID NO: 1887 - DNA, 9 bp, Artificial Sequence
  Synthetic nucleic acid molecule
agcaagggc

SEQ ID NO: 1888 - DNA, 9 bp, Artificial Sequence
  Synthetic nucleic acid molecule
tgctgagtc

SEQ ID NO: 1889 - DNA, 9 bp, Artificial Sequence
  Synthetic nucleic acid molecule
agcattgtt

SEQ ID NO: 1890 - DNA, 9 bp, Artificial Sequence
  Synthetic nucleic acid molecule
agcattgtg

SEQ ID NO: 1891 - DNA, 9 bp, Artificial Sequence
  Synthetic nucleic acid molecule
gctagcgtc

SEQ ID NO: 1892 - DNA, 9 bp, Artificial Sequence
  Synthetic nucleic acid molecule
agcaacttt

SEQ ID NO: 1893 - DNA, 9 bp, Artificial Sequence
  Synthetic nucleic acid molecule
agtagggtt

SEQ ID NO: 1894 - DNA, 9 bp, Artificial Sequence
  Synthetic nucleic acid molecule
ggcagtgtt

SEQ ID NO: 1895 - DNA, 9 bp, Artificial Sequence
  Synthetic nucleic acid molecule
aactgagtc

SEQ ID NO: 1896 - DNA, 9 bp, Artificial Sequence
  Synthetic nucleic acid molecule
agcattgtg

SEQ ID NO: 1897 - DNA, 9 bp, Artificial Sequence
  Synthetic nucleic acid molecule
agcaaggtt

SEQ ID NO: 1898 - DNA, 9 bp, Artificial Sequence
  Synthetic nucleic acid molecule
ggcaacgtt

SEQ ID NO: 1899 - DNA, 9 bp, Artificial Sequence
  Synthetic nucleic acid molecule
aacaacctc

SEQ ID NO: 1900 - DNA, 9 bp, Artificial Sequence
  Synthetic nucleic acid molecule
agggacgtc

SEQ ID NO: 1901 - DNA, 9 bp, Artificial Sequence
  Synthetic nucleic acid molecule
tccagtgtc

SEQ ID NO: 1902 - DNA, 9 bp, Artificial Sequence
  Synthetic nucleic acid molecule
agcatggtt

SEQ ID NO: 1903 - DNA, 9 bp, Artificial Sequence
  Synthetic nucleic acid molecule
aatagggtc

SEQ ID NO: 1904 - DNA, 9 bp, Artificial Sequence
  Synthetic nucleic acid molecule
agtatagtc

SEQ ID NO: 1905 - DNA, 9 bp, Artificial Sequence
  Synthetic nucleic acid molecule
tgcaatgtc

SEQ ID NO: 1906 - DNA, 9 bp, Artificial Sequence
  Synthetic nucleic acid molecule
agctacatc

SEQ ID NO: 1907 - DNA, 9 bp, Artificial Sequence
  Synthetic nucleic acid molecule
agcaaagta

SEQ ID NO: 1908 - DNA, 9 bp, Artificial Sequence
  Synthetic nucleic acid molecule
caccccgtc

SEQ ID NO: 1909 - DNA, 9 bp, Artificial Sequence
  Synthetic nucleic acid molecule
aggcacgtt

SEQ ID NO: 1910 - DNA, 9 bp, Artificial Sequence
  Synthetic nucleic acid molecule
caccccgtc

SEQ ID NO: 1911 - DNA, 9 bp, Artificial Sequence
  Synthetic nucleic acid molecule
gcaagagtc

SEQ ID NO: 1912 - DNA, 9 bp, Artificial Sequence
  Synthetic nucleic acid molecule
agtgcagtc

SEQ ID NO: 1913 - DNA, 9 bp, Artificial Sequence
  Synthetic nucleic acid molecule
atccacgtt

SEQ ID NO: 1914 - DNA, 9 bp, Artificial Sequence
  Synthetic nucleic acid molecule
atccacgtt

SEQ ID NO: 1915 - DNA, 9 bp, Artificial Sequence
  Synthetic nucleic acid molecule
agcagcttc

SEQ ID NO: 1916 - DNA, 9 bp, Artificial Sequence
  Synthetic nucleic acid molecule
agcagggtc

SEQ ID NO: 1917 - DNA, 9 bp, Artificial Sequence
  Synthetic nucleic acid molecule
agcagcttc

SEQ ID NO: 1918 - DNA, 9 bp, Artificial Sequence
  Synthetic nucleic acid molecule
agcagggtc

SEQ ID NO: 1919 - DNA, 9 bp, Artificial Sequence
  Synthetic nucleic acid molecule
agcaactgc

SEQ ID NO: 1920 - DNA, 9 bp, Artificial Sequence
  Synthetic nucleic acid molecule
agcaactgc

SEQ ID NO: 1921 - DNA, 9 bp, Artificial Sequence
  Synthetic nucleic acid molecule
agcagcttc

SEQ ID NO: 1922 - DNA, 9 bp, Artificial Sequence
  Synthetic nucleic acid molecule
aggtgcctc

SEQ ID NO: 1923 - DNA, 9 bp, Artificial Sequence
  Synthetic nucleic acid molecule
agctcagtc

SEQ ID NO: 1924 - DNA, 9 bp, Artificial Sequence
  Synthetic nucleic acid molecule
agcagcgtg

SEQ ID NO: 1925 - DNA, 9 bp, Artificial Sequence
  Synthetic nucleic acid molecule
agcagcgtg

SEQ ID NO: 1926 - DNA, 9 bp, Artificial Sequence
  Synthetic nucleic acid molecule
agcagcgtg

SEQ ID NO: 1927 - DNA, 9 bp, Artificial Sequence
  Synthetic nucleic acid molecule
agcagcgtg

SEQ ID NO: 1928 - DNA, 9 bp, Artificial Sequence
  Synthetic nucleic acid molecule
agcagcctc

SEQ ID NO: 1929 - DNA, 9 bp, Artificial Sequence
  Synthetic nucleic acid molecule
agcagcctc

SEQ ID NO: 1930 - DNA, 9 bp, Artificial Sequence
  Synthetic nucleic acid molecule
aggagcgtc

SEQ ID NO: 1931 - DNA, 9 bp, Artificial Sequence
  Synthetic nucleic acid molecule
agcagcgac

SEQ ID NO: 1932 - DNA, 9 bp, Artificial Sequence
  Synthetic nucleic acid molecule
agctgcgtc

SEQ ID NO: 1933 - DNA, 9 bp, Artificial Sequence
  Synthetic nucleic acid molecule
agcagggtc

SEQ ID NO: 1934 - DNA, 9 bp, Artificial Sequence
  Synthetic nucleic acid molecule
agcagcatc

SEQ ID NO: 1935 - DNA, 9 bp, Artificial Sequence
  Synthetic nucleic acid molecule
aggagcgtc

SEQ ID NO: 1936 - DNA, 9 bp, Artificial Sequence
  Synthetic nucleic acid molecule
agcagcgtg

SEQ ID NO: 1937 - DNA, 9 bp, Artificial Sequence
  Synthetic nucleic acid molecule
agcagcgtg

SEQ ID NO: 1938 - DNA, 9 bp, Artificial Sequence
  Synthetic nucleic acid molecule
agcagcatc

SEQ ID NO: 1939 - DNA, 9 bp, Artificial Sequence
  Synthetic nucleic acid molecule
accagcgtc

SEQ ID NO: 1940 - DNA, 9 bp, Artificial Sequence
  Synthetic nucleic acid molecule
agcagggtc

SEQ ID NO: 1941 - DNA, 9 bp, Artificial Sequence
  Synthetic nucleic acid molecule
aggagcgac

SEQ ID NO: 1942 - DNA, 9 bp, Artificial Sequence
  Synthetic nucleic acid molecule
aggagcgac

SEQ ID NO: 1943 - DNA, 9 bp, Artificial Sequence
  Synthetic nucleic acid molecule
aggagcgac

SEQ ID NO: 1944 - DNA, 9 bp, Artificial Sequence
  Synthetic nucleic acid molecule
aggagcgac

SEQ ID NO: 1945 - DNA, 9 bp, Artificial Sequence
  Synthetic nucleic acid molecule
aggagcgac

SEQ ID NO: 1946 - DNA, 9 bp, Artificial Sequence
  Synthetic nucleic acid molecule
aggagcgac

SEQ ID NO: 1947 - DNA, 9 bp, Artificial Sequence
  Synthetic nucleic acid molecule
aggagcgac

SEQ ID NO: 1948 - DNA, 9 bp, Artificial Sequence
  Synthetic nucleic acid molecule
aggagcgac

SEQ ID NO: 1949 - DNA, 9 bp, Artificial Sequence
  Synthetic nucleic acid molecule
aggagcgac

SEQ ID NO: 1950 - DNA, 9 bp, Artificial Sequence
  Synthetic nucleic acid molecule
aggagcgac

SEQ ID NO: 1951 - DNA, 9 bp, Artificial Sequence
  Synthetic nucleic acid molecule
aggagcgac

SEQ ID NO: 1952 - DNA, 9 bp, Artificial Sequence
  Synthetic nucleic acid molecule
aggagcgac

SEQ ID NO: 1953 - DNA, 9 bp, Artificial Sequence
  Synthetic nucleic acid molecule
aggagcgac

SEQ ID NO: 1954 - DNA, 9 bp, Artificial Sequence
  Synthetic nucleic acid molecule
aggagcgac

SEQ ID NO: 1955 - DNA, 9 bp, Artificial Sequence
  Synthetic nucleic acid molecule
aggagcgac

SEQ ID NO: 1956 - DNA, 9 bp, Artificial Sequence
  Synthetic nucleic acid molecule
aggagcgac

SEQ ID NO: 1957 - DNA, 9 bp, Artificial Sequence
  Synthetic nucleic acid molecule
aggagcgac

SEQ ID NO: 1958 - DNA, 9 bp, Artificial Sequence
  Synthetic nucleic acid molecule
aggagcgac

SEQ ID NO: 1959 - DNA, 9 bp, Artificial Sequence
  Synthetic nucleic acid molecule
aggagcgac

SEQ ID NO: 1960 - DNA, 9 bp, Artificial Sequence
  Synthetic nucleic acid molecule
aggagcgac

SEQ ID NO: 1961 - DNA, 9 bp, Artificial Sequence
  Synthetic nucleic acid molecule
aggagcgac

SEQ ID NO: 1962 - DNA, 9 bp, Artificial Sequence
  Synthetic nucleic acid molecule
aggagcgac

SEQ ID NO: 1963 - DNA, 9 bp, Artificial Sequence
  Synthetic nucleic acid molecule
aggagcgac

SEQ ID NO: 1964 - DNA, 9 bp, Artificial Sequence
  Synthetic nucleic acid molecule
aggagcgac

SEQ ID NO: 1965 - DNA, 9 bp, Artificial Sequence
  Synthetic nucleic acid molecule
aggagcgac

SEQ ID NO: 1966 - DNA, 9 bp, Artificial Sequence
  Synthetic nucleic acid molecule
aggagcgac

SEQ ID NO: 1967 - DNA, 9 bp, Artificial Sequence
  Synthetic nucleic acid molecule
aggagcgac

SEQ ID NO: 1968 - DNA, 9 bp, Artificial Sequence
  Synthetic nucleic acid molecule
aggagcgac

SEQ ID NO: 1969 - DNA, 9 bp, Artificial Sequence
  Synthetic nucleic acid molecule
aggagcgac

SEQ ID NO: 1970 - DNA, 9 bp, Artificial Sequence
  Synthetic nucleic acid molecule
aggagcgac

SEQ ID NO: 1971 - DNA, 9 bp, Artificial Sequence
  Synthetic nucleic acid molecule
aggagcgac

SEQ ID NO: 1972 - DNA, 9 bp, Artificial Sequence
  Synthetic nucleic acid molecule
aggagcgac

SEQ ID NO: 1973 - DNA, 9 bp, Artificial Sequence
  Synthetic nucleic acid molecule
aggagcgac

SEQ ID NO: 1974 - DNA, 9 bp, Artificial Sequence
  Synthetic nucleic acid molecule
aggagcgac

SEQ ID NO: 1975 - DNA, 9 bp, Artificial Sequence
  Synthetic nucleic acid molecule
aacagcctc

SEQ ID NO: 1976 - DNA, 9 bp, Artificial Sequence
  Synthetic nucleic acid molecule
agaagcatc

SEQ ID NO: 1977 - DNA, 9 bp, Artificial Sequence
  Synthetic nucleic acid molecule
agaagcctc

SEQ ID NO: 1978 - DNA, 9 bp, Artificial Sequence
  Synthetic nucleic acid molecule
agcagcgtc

SEQ ID NO: 1979 - DNA, 9 bp, Artificial Sequence
  Synthetic nucleic acid molecule
agcagcgtc

SEQ ID NO: 1980 - DNA, 9 bp, Artificial Sequence
  Synthetic nucleic acid molecule
agcagcgtc

SEQ ID NO: 1981 - DNA, 9 bp, Artificial Sequence
  Synthetic nucleic acid molecule
agcagcgtc

SEQ ID NO: 1982 - DNA, 9 bp, Artificial Sequence
  Synthetic nucleic acid molecule
agcagcgtc

SEQ ID NO: 1983 - DNA, 9 bp, Artificial Sequence
  Synthetic nucleic acid molecule
agcagcgtc

SEQ ID NO: 1984 - DNA, 9 bp, Artificial Sequence
  Synthetic nucleic acid molecule
agcagcgtc

SEQ ID NO: 1985 - DNA, 9 bp, Artificial Sequence
  Synthetic nucleic acid molecule
agcagcgtc

SEQ ID NO: 1986 - DNA, 9 bp, Artificial Sequence
  Synthetic nucleic acid molecule
agcagcgtc

SEQ ID NO: 1987 - DNA, 9 bp, Artificial Sequence
  Synthetic nucleic acid molecule
agcagcgtc

SEQ ID NO: 1988 - DNA, 9 bp, Artificial Sequence
  Synthetic nucleic acid molecule
agcagcgtc

SEQ ID NO: 1989 - DNA, 9 bp, Artificial Sequence
  Synthetic nucleic acid molecule
agcagcgtc

SEQ ID NO: 1990 - DNA, 9 bp, Artificial Sequence
  Synthetic nucleic acid molecule
agcagcgtc

SEQ ID NO: 1991 - DNA, 9 bp, Artificial Sequence
  Synthetic nucleic acid molecule
agcagcgtc

SEQ ID NO: 1992 - DNA, 9 bp, Artificial Sequence
  Synthetic nucleic acid molecule
agcagcgtc

SEQ ID NO: 1993 - DNA, 9 bp, Artificial Sequence
  Synthetic nucleic acid molecule
agcagcgtc

SEQ ID NO: 1994 - DNA, 9 bp, Artificial Sequence
  Synthetic nucleic acid molecule
agcagcgtc

SEQ ID NO: 1995 - DNA, 9 bp, Artificial Sequence
  Synthetic nucleic acid molecule
agcagcgtc

SEQ ID NO: 1996 - DNA, 9 bp, Artificial Sequence
  Synthetic nucleic acid molecule
agcagcgtc

SEQ ID NO: 1997 - DNA, 9 bp, Artificial Sequence
  Synthetic nucleic acid molecule
agcagcgtc

SEQ ID NO: 1998 - DNA, 9 bp, Artificial Sequence
  Synthetic nucleic acid molecule
agcagcgtc

SEQ ID NO: 1999 - DNA, 9 bp, Artificial Sequence
  Synthetic nucleic acid molecule
agcagtgtc

SEQ ID NO: 2000 - DNA, 9 bp, Artificial Sequence
  Synthetic nucleic acid molecule
agcagagtc

SEQ ID NO: 2001 - DNA, 9 bp, Artificial Sequence
  Synthetic nucleic acid molecule
atcagcgtc

SEQ ID NO: 2002 - DNA, 9 bp, Artificial Sequence
  Synthetic nucleic acid molecule
agcagagtc

SEQ ID NO: 2003 - DNA, 9 bp, Artificial Sequence
  Synthetic nucleic acid molecule
aacagcgtc

SEQ ID NO: 2004 - DNA, 9 bp, Artificial Sequence
  Synthetic nucleic acid molecule
tgcagcgtc

SEQ ID NO: 2005 - DNA, 9 bp, Artificial Sequence
  Synthetic nucleic acid molecule
agcagcttc

SEQ ID NO: 2006 - DNA, 9 bp, Artificial Sequence
  Synthetic nucleic acid molecule
agcagtgtc

SEQ ID NO: 2007 - DNA, 9 bp, Artificial Sequence
  Synthetic nucleic acid molecule
agcagcatc

SEQ ID NO: 2008 - DNA, 9 bp, Artificial Sequence
  Synthetic nucleic acid molecule
agcagtgtc

SEQ ID NO: 2009 - DNA, 9 bp, Artificial Sequence
  Synthetic nucleic acid molecule
agcagcttc

SEQ ID NO: 2010 - DNA, 9 bp, Artificial Sequence
  Synthetic nucleic acid molecule
agcagagtc

SEQ ID NO: 2011 - DNA, 9 bp, Artificial Sequence
  Synthetic nucleic acid molecule
agcagggtc

SEQ ID NO: 2012 - DNA, 9 bp, Artificial Sequence
  Synthetic nucleic acid molecule
agctgcgtc

SEQ ID NO: 2013 - DNA, 9 bp, Artificial Sequence
  Synthetic nucleic acid molecule
agcagcgta

SEQ ID NO: 2014 - DNA, 9 bp, Artificial Sequence
  Synthetic nucleic acid molecule
agcagcctc

SEQ ID NO: 2015 - DNA, 9 bp, Artificial Sequence
  Synthetic nucleic acid molecule
agcagcgtt

SEQ ID NO: 2016 - DNA, 9 bp, Artificial Sequence
  Synthetic nucleic acid molecule
agcagcctc

SEQ ID NO: 2017 - DNA, 9 bp, Artificial Sequence
  Synthetic nucleic acid molecule
agcagtgtc

SEQ ID NO: 2018 - DNA, 9 bp, Artificial Sequence
  Synthetic nucleic acid molecule
agcagtgtc

SEQ ID NO: 2019 - DNA, 9 bp, Artificial Sequence
  Synthetic nucleic acid molecule
agcagcatc

SEQ ID NO: 2020 - DNA, 9 bp, Artificial Sequence
  Synthetic nucleic acid molecule
agcagcatc

SEQ ID NO: 2021 - DNA, 9 bp, Artificial Sequence
  Synthetic nucleic acid molecule
agcagggtc

SEQ ID NO: 2022 - DNA, 9 bp, Artificial Sequence
  Synthetic nucleic acid molecule
atcagcgtc

SEQ ID NO: 2023 - DNA, 9 bp, Artificial Sequence
  Synthetic nucleic acid molecule
agcagcatc

SEQ ID NO: 2024 - DNA, 9 bp, Artificial Sequence
  Synthetic nucleic acid molecule
agcagcatc

SEQ ID NO: 2025 - DNA, 9 bp, Artificial Sequence
  Synthetic nucleic acid molecule
agcagcatc

SEQ ID NO: 2026 - DNA, 9 bp, Artificial Sequence
  Synthetic nucleic acid molecule
agcagcatc

SEQ ID NO: 2027 - DNA, 9 bp, Artificial Sequence
  Synthetic nucleic acid molecule
agcagtgtc

SEQ ID NO: 2028 - DNA, 9 bp, Artificial Sequence
  Synthetic nucleic acid molecule
agcagcttc

SEQ ID NO: 2029 - DNA, 9 bp, Artificial Sequence
  Synthetic nucleic acid molecule
agcagcgtg

SEQ ID NO: 2030 - DNA, 9 bp, Artificial Sequence
  Synthetic nucleic acid molecule
agtagcgtc

SEQ ID NO: 2031 - DNA, 9 bp, Artificial Sequence
  Synthetic nucleic acid molecule
agcagcttc

SEQ ID NO: 2032 - DNA, 9 bp, Artificial Sequence
  Synthetic nucleic acid molecule
agcagcgtg

SEQ ID NO: 2033 - DNA, 9 bp, Artificial Sequence
  Synthetic nucleic acid molecule
atcagcgtc

SEQ ID NO: 2034 - DNA, 9 bp, Artificial Sequence
  Synthetic nucleic acid molecule
agcagcatc

SEQ ID NO: 2035 - DNA, 9 bp, Artificial Sequence
  Synthetic nucleic acid molecule
agcagtgtc

SEQ ID NO: 2036 - DNA, 9 bp, Artificial Sequence
  Synthetic nucleic acid molecule
agcagcgac

SEQ ID NO: 2037 - DNA, 9 bp, Artificial Sequence
  Synthetic nucleic acid molecule
agcagtgtc

SEQ ID NO: 2038 - DNA, 9 bp, Artificial Sequence
  Synthetic nucleic acid molecule
agcagcgtg

SEQ ID NO: 2039 - DNA, 9 bp, Artificial Sequence
  Synthetic nucleic acid molecule
agcagcttc

SEQ ID NO: 2040 - DNA, 9 bp, Artificial Sequence
  Synthetic nucleic acid molecule
agcagagtc

SEQ ID NO: 2041 - DNA, 9 bp, Artificial Sequence
  Synthetic nucleic acid molecule
agcagcttc

SEQ ID NO: 2042 - DNA, 9 bp, Artificial Sequence
  Synthetic nucleic acid molecule
agcagtgtc

SEQ ID NO: 2043 - DNA, 9 bp, Artificial Sequence
  Synthetic nucleic acid molecule
agccgcgtc

SEQ ID NO: 2044 - DNA, 9 bp, Artificial Sequence
  Synthetic nucleic acid molecule
tgcagcgtc

SEQ ID NO: 2045 - DNA, 9 bp, Artificial Sequence
  Synthetic nucleic acid molecule
agcagcatc

SEQ ID NO: 2046 - DNA, 9 bp, Artificial Sequence
  Synthetic nucleic acid molecule
agcagcgtg

SEQ ID NO: 2047 - DNA, 9 bp, Artificial Sequence
  Synthetic nucleic acid molecule
agcagtgtc

SEQ ID NO: 2048 - DNA, 9 bp, Artificial Sequence
  Synthetic nucleic acid molecule
agcagcgcc

SEQ ID NO: 2049 - DNA, 9 bp, Artificial Sequence
  Synthetic nucleic acid molecule
agcagcatc

SEQ ID NO: 2050 - DNA, 9 bp, Artificial Sequence
  Synthetic nucleic acid molecule
agcagcctc

SEQ ID NO: 2051 - DNA, 9 bp, Artificial Sequence
  Synthetic nucleic acid molecule
ggcagcgtc

SEQ ID NO: 2052 - DNA, 9 bp, Artificial Sequence
  Synthetic nucleic acid molecule
agcagcctc

SEQ ID NO: 2053 - DNA, 9 bp, Artificial Sequence
  Synthetic nucleic acid molecule
agcagagtc

SEQ ID NO: 2054 - DNA, 9 bp, Artificial Sequence
  Synthetic nucleic acid molecule
tgcagcgtc

SEQ ID NO: 2055 - DNA, 9 bp, Artificial Sequence
  Synthetic nucleic acid molecule
agcagggtc

SEQ ID NO: 2056 - DNA, 9 bp, Artificial Sequence
  Synthetic nucleic acid molecule
agcagagtc

SEQ ID NO: 2057 - DNA, 9 bp, Artificial Sequence
  Synthetic nucleic acid molecule
agcagggtc

SEQ ID NO: 2058 - DNA, 9 bp, Artificial Sequence
  Synthetic nucleic acid molecule
agcagcctc

SEQ ID NO: 2059 - DNA, 9 bp, Artificial Sequence
  Synthetic nucleic acid molecule
agcagcggc

SEQ ID NO: 2060 - DNA, 9 bp, Artificial Sequence
  Synthetic nucleic acid molecule
agcagggtc

SEQ ID NO: 2061 - DNA, 9 bp, Artificial Sequence
  Synthetic nucleic acid molecule
agcagtgtc

SEQ ID NO: 2062 - DNA, 9 bp, Artificial Sequence
  Synthetic nucleic acid molecule
agcagcggc

SEQ ID NO: 2063 - DNA, 9 bp, Artificial Sequence
  Synthetic nucleic acid molecule
agcagcatc

SEQ ID NO: 2064 - DNA, 9 bp, Artificial Sequence
  Synthetic nucleic acid molecule
agcagggtc

SEQ ID NO: 2065 - DNA, 9 bp, Artificial Sequence
  Synthetic nucleic acid molecule
agcagggtc

SEQ ID NO: 2066 - DNA, 9 bp, Artificial Sequence
  Synthetic nucleic acid molecule
agcagtgtc

SEQ ID NO: 2067 - DNA, 9 bp, Artificial Sequence
  Synthetic nucleic acid molecule
agcagcctc

SEQ ID NO: 2068 - DNA, 9 bp, Artificial Sequence
  Synthetic nucleic acid molecule
agcagcgcc

SEQ ID NO: 2069 - DNA, 9 bp, Artificial Sequence
  Synthetic nucleic acid molecule
agcagcgac

SEQ ID NO: 2070 - DNA, 9 bp, Artificial Sequence
  Synthetic nucleic acid molecule
agcagcttc

SEQ ID NO: 2071 - DNA, 9 bp, Artificial Sequence
  Synthetic nucleic acid molecule
agcagggtc

SEQ ID NO: 2072 - DNA, 9 bp, Artificial Sequence
  Synthetic nucleic acid molecule
agcagcgac

SEQ ID NO: 2073 - DNA, 9 bp, Artificial Sequence
  Synthetic nucleic acid molecule
agcagcgtg

SEQ ID NO: 2074 - DNA, 9 bp, Artificial Sequence
  Synthetic nucleic acid molecule
ggcagcgtc

SEQ ID NO: 2075 - DNA, 9 bp, Artificial Sequence
  Synthetic nucleic acid molecule
agcagcctc

SEQ ID NO: 2076 - DNA, 9 bp, Artificial Sequence
  Synthetic nucleic acid molecule
agcagcctc

SEQ ID NO: 2077 - DNA, 9 bp, Artificial Sequence
  Synthetic nucleic acid molecule
tgcagcgtc

SEQ ID NO: 2078 - DNA, 9 bp, Artificial Sequence
  Synthetic nucleic acid molecule
agcagtgtc

SEQ ID NO: 2079 - DNA, 9 bp, Artificial Sequence
  Synthetic nucleic acid molecule
agcaacgtc

SEQ ID NO: 2080 - DNA, 9 bp, Artificial Sequence
  Synthetic nucleic acid molecule
agcagcatc

SEQ ID NO: 2081 - DNA, 9 bp, Artificial Sequence
  Synthetic nucleic acid molecule
agcagcctc

SEQ ID NO: 2082 - DNA, 9 bp, Artificial Sequence
  Synthetic nucleic acid molecule
agcagggtc

SEQ ID NO: 2083 - DNA, 9 bp, Artificial Sequence
  Synthetic nucleic acid molecule
agcagcggc

SEQ ID NO: 2084 - DNA, 9 bp, Artificial Sequence
  Synthetic nucleic acid molecule
agcagggtc

SEQ ID NO: 2085 - DNA, 9 bp, Artificial Sequence
  Synthetic nucleic acid molecule
agcagcatc

SEQ ID NO: 2086 - DNA, 9 bp, Artificial Sequence
  Synthetic nucleic acid molecule
agcagagtc

SEQ ID NO: 2087 - DNA, 9 bp, Artificial Sequence
  Synthetic nucleic acid molecule
agcagcgcc

SEQ ID NO: 2088 - DNA, 9 bp, Artificial Sequence
  Synthetic nucleic acid molecule
agcagcggc

SEQ ID NO: 2089 - DNA, 9 bp, Artificial Sequence
  Synthetic nucleic acid molecule
agcagcctc

SEQ ID NO: 2090 - DNA, 9 bp, Artificial Sequence
  Synthetic nucleic acid molecule
agcatcgtc

SEQ ID NO: 2091 - DNA, 9 bp, Artificial Sequence
  Synthetic nucleic acid molecule
ggcagcgtc

SEQ ID NO: 2092 - DNA, 9 bp, Artificial Sequence
  Synthetic nucleic acid molecule
agcagcctc

SEQ ID NO: 2093 - DNA, 9 bp, Artificial Sequence
  Synthetic nucleic acid molecule
agcagtgtc

SEQ ID NO: 2094 - DNA, 9 bp, Artificial Sequence
  Synthetic nucleic acid molecule
ggcagcgtc

SEQ ID NO: 2095 - DNA, 9 bp, Artificial Sequence
  Synthetic nucleic acid molecule
agcagtgtc

SEQ ID NO: 2096 - DNA, 9 bp, Artificial Sequence
  Synthetic nucleic acid molecule
agcagcatc

SEQ ID NO: 2097 - DNA, 9 bp, Artificial Sequence
  Synthetic nucleic acid molecule
agcagtgtc

SEQ ID NO: 2098 - DNA, 9 bp, Artificial Sequence
  Synthetic nucleic acid molecule
agcagagtc

SEQ ID NO: 2099 - DNA, 9 bp, Artificial Sequence
  Synthetic nucleic acid molecule
agtagcgtc

SEQ ID NO: 2100 - DNA, 9 bp, Artificial Sequence
  Synthetic nucleic acid molecule
agcagcctc

SEQ ID NO: 2101 - DNA, 9 bp, Artificial Sequence
  Synthetic nucleic acid molecule
agcagtgtc

SEQ ID NO: 2102 - DNA, 9 bp, Artificial Sequence
  Synthetic nucleic acid molecule
agcagcgtt

SEQ ID NO: 2103 - DNA, 9 bp, Artificial Sequence
  Synthetic nucleic acid molecule
agcagcgac

SEQ ID NO: 2104 - DNA, 9 bp, Artificial Sequence
  Synthetic nucleic acid molecule
agcagagtc

SEQ ID NO: 2105 - DNA, 9 bp, Artificial Sequence
  Synthetic nucleic acid molecule
ggcagcgtc

SEQ ID NO: 2106 - DNA, 9 bp, Artificial Sequence
  Synthetic nucleic acid molecule
agcagggtc

SEQ ID NO: 2107 - DNA, 9 bp, Artificial Sequence
  Synthetic nucleic acid molecule
agcagcatc

SEQ ID NO: 2108 - DNA, 9 bp, Artificial Sequence
  Synthetic nucleic acid molecule
agcagtgtc

SEQ ID NO: 2109 - DNA, 9 bp, Artificial Sequence
  Synthetic nucleic acid molecule
agcagggtc

SEQ ID NO: 2110 - DNA, 9 bp, Artificial Sequence
  Synthetic nucleic acid molecule
agcagagtc

SEQ ID NO: 2111 - DNA, 9 bp, Artificial Sequence
  Synthetic nucleic acid molecule
agcagcgtg

SEQ ID NO: 2112 - DNA, 9 bp, Artificial Sequence
  Synthetic nucleic acid molecule
agcagcgtg

SEQ ID NO: 2113 - DNA, 9 bp, Artificial Sequence
  Synthetic nucleic acid molecule
agcagcatc

SEQ ID NO: 2114 - DNA, 9 bp, Artificial Sequence
  Synthetic nucleic acid molecule
agcagcctc

SEQ ID NO: 2115 - DNA, 9 bp, Artificial Sequence
  Synthetic nucleic acid molecule
agcagcttc

SEQ ID NO: 2116 - DNA, 9 bp, Artificial Sequence
  Synthetic nucleic acid molecule
atcagcgtc

SEQ ID NO: 2117 - DNA, 9 bp, Artificial Sequence
  Synthetic nucleic acid molecule
agcagcatc

SEQ ID NO: 2118 - DNA, 9 bp, Artificial Sequence
  Synthetic nucleic acid molecule
agcagcatc

SEQ ID NO: 2119 - DNA, 9 bp, Artificial Sequence
  Synthetic nucleic acid molecule
tgcagcgtc

SEQ ID NO: 2120 - DNA, 9 bp, Artificial Sequence
  Synthetic nucleic acid molecule
agcagcttc

SEQ ID NO: 2121 - DNA, 9 bp, Artificial Sequence
  Synthetic nucleic acid molecule
agcagcctc

SEQ ID NO: 2122 - DNA, 9 bp, Artificial Sequence
  Synthetic nucleic acid molecule
agcagcgcc

SEQ ID NO: 2123 - DNA, 9 bp, Artificial Sequence
  Synthetic nucleic acid molecule
agcagggtc

SEQ ID NO: 2124 - DNA, 9 bp, Artificial Sequence
  Synthetic nucleic acid molecule
agcagcctc

SEQ ID NO: 2125 - DNA, 9 bp, Artificial Sequence
  Synthetic nucleic acid molecule
ggcagcgtc

SEQ ID NO: 2126 - DNA, 9 bp, Artificial Sequence
  Synthetic nucleic acid molecule
agcagagtc

SEQ ID NO: 2127 - DNA, 9 bp, Artificial Sequence
  Synthetic nucleic acid molecule
agcagcgac

SEQ ID NO: 2128 - DNA, 9 bp, Artificial Sequence
  Synthetic nucleic acid molecule
agcagtgtc

SEQ ID NO: 2129 - DNA, 9 bp, Artificial Sequence
  Synthetic nucleic acid molecule
agcagggtc

SEQ ID NO: 2130 - DNA, 9 bp, Artificial Sequence
  Synthetic nucleic acid molecule
agcagcggc

SEQ ID NO: 2131 - DNA, 9 bp, Artificial Sequence
  Synthetic nucleic acid molecule
tgcagcgtc

SEQ ID NO: 2132 - DNA, 9 bp, Artificial Sequence
  Synthetic nucleic acid molecule
agaagcgtc

SEQ ID NO: 2133 - DNA, 9 bp, Artificial Sequence
  Synthetic nucleic acid molecule
agcagggtc

SEQ ID NO: 2134 - DNA, 9 bp, Artificial Sequence
  Synthetic nucleic acid molecule
agcagcatc

SEQ ID NO: 2135 - DNA, 9 bp, Artificial Sequence
  Synthetic nucleic acid molecule
agtagcgtc

SEQ ID NO: 2136 - DNA, 9 bp, Artificial Sequence
  Synthetic nucleic acid molecule
agcagggtc

SEQ ID NO: 2137 - DNA, 9 bp, Artificial Sequence
  Synthetic nucleic acid molecule
agcagggtc

SEQ ID NO: 2138 - DNA, 9 bp, Artificial Sequence
  Synthetic nucleic acid molecule
agcagggtc

SEQ ID NO: 2139 - DNA, 9 bp, Artificial Sequence
  Synthetic nucleic acid molecule
agcaacctc

SEQ ID NO: 2140 - DNA, 9 bp, Artificial Sequence
  Synthetic nucleic acid molecule
agcaacgtg

SEQ ID NO: 2141 - DNA, 9 bp, Artificial Sequence
  Synthetic nucleic acid molecule
atcagggtc

SEQ ID NO: 2142 - DNA, 9 bp, Artificial Sequence
  Synthetic nucleic acid molecule
agcaaagtc

SEQ ID NO: 2143 - DNA, 9 bp, Artificial Sequence
  Synthetic nucleic acid molecule
agcagtgta

SEQ ID NO: 2144 - DNA, 9 bp, Artificial Sequence
  Synthetic nucleic acid molecule
agcagagta

SEQ ID NO: 2145 - DNA, 9 bp, Artificial Sequence
  Synthetic nucleic acid molecule
agcagcctg

SEQ ID NO: 2146 - DNA, 9 bp, Artificial Sequence
  Synthetic nucleic acid molecule
agcaacctc

SEQ ID NO: 2147 - DNA, 9 bp, Artificial Sequence
  Synthetic nucleic acid molecule
aacagcttc

SEQ ID NO: 2148 - DNA, 9 bp, Artificial Sequence
  Synthetic nucleic acid molecule
agtagtgtc

SEQ ID NO: 2149 - DNA, 9 bp, Artificial Sequence
  Synthetic nucleic acid molecule
atcagggtc

SEQ ID NO: 2150 - DNA, 9 bp, Artificial Sequence
  Synthetic nucleic acid molecule
ggcagggtc

SEQ ID NO: 2151 - DNA, 9 bp, Artificial Sequence
  Synthetic nucleic acid molecule
agctgggtc

SEQ ID NO: 2152 - DNA, 9 bp, Artificial Sequence
  Synthetic nucleic acid molecule
agctgggtc

SEQ ID NO: 2153 - DNA, 9 bp, Artificial Sequence
  Synthetic nucleic acid molecule
agcagctcc

SEQ ID NO: 2154 - DNA, 9 bp, Artificial Sequence
  Synthetic nucleic acid molecule
agcaacatc

SEQ ID NO: 2155 - DNA, 9 bp, Artificial Sequence
  Synthetic nucleic acid molecule
aacagcttc

SEQ ID NO: 2156 - DNA, 9 bp, Artificial Sequence
  Synthetic nucleic acid molecule
atcagcgcc

SEQ ID NO: 2157 - DNA, 9 bp, Artificial Sequence
  Synthetic nucleic acid molecule
agcaggggc

SEQ ID NO: 2158 - DNA, 9 bp, Artificial Sequence
  Synthetic nucleic acid molecule
agcatggtc

SEQ ID NO: 2159 - DNA, 9 bp, Artificial Sequence
  Synthetic nucleic acid molecule
ggcagcgtg

SEQ ID NO: 2160 - DNA, 9 bp, Artificial Sequence
  Synthetic nucleic acid molecule
agcagagcc

SEQ ID NO: 2161 - DNA, 9 bp, Artificial Sequence
  Synthetic nucleic acid molecule
agcaccgtg

SEQ ID NO: 2162 - DNA, 9 bp, Artificial Sequence
  Synthetic nucleic acid molecule
cccagcgtc

SEQ ID NO: 2163 - DNA, 9 bp, Artificial Sequence
  Synthetic nucleic acid molecule
aggagcgtg

SEQ ID NO: 2164 - DNA, 9 bp, Artificial Sequence
  Synthetic nucleic acid molecule
agccgagtc

SEQ ID NO: 2165 - DNA, 9 bp, Artificial Sequence
  Synthetic nucleic acid molecule
agtagagtc

SEQ ID NO: 2166 - DNA, 9 bp, Artificial Sequence
  Synthetic nucleic acid molecule
accagggtc

SEQ ID NO: 2167 - DNA, 9 bp, Artificial Sequence
  Synthetic nucleic acid molecule
tgcagggtc

SEQ ID NO: 2168 - DNA, 9 bp, Artificial Sequence
  Synthetic nucleic acid molecule
agcagcggg

SEQ ID NO: 2169 - DNA, 9 bp, Artificial Sequence
  Synthetic nucleic acid molecule
tgcagcgcc

SEQ ID NO: 2170 - DNA, 9 bp, Artificial Sequence
  Synthetic nucleic acid molecule
agtagagtc

SEQ ID NO: 2171 - DNA, 9 bp, Artificial Sequence
  Synthetic nucleic acid molecule
tgcagcgcc

SEQ ID NO: 2172 - DNA, 9 bp, Artificial Sequence
  Synthetic nucleic acid molecule
agtagggtc

SEQ ID NO: 2173 - DNA, 9 bp, Artificial Sequence
  Synthetic nucleic acid molecule
tgcagcgcc

SEQ ID NO: 2174 - DNA, 9 bp, Artificial Sequence
  Synthetic nucleic acid molecule
tgcagcgcc

SEQ ID NO: 2175 - DNA, 9 bp, Artificial Sequence
  Synthetic nucleic acid molecule
tgcagcgcc

SEQ ID NO: 2176 - DNA, 9 bp, Artificial Sequence
  Synthetic nucleic acid molecule
tgcagcgcc

SEQ ID NO: 2177 - DNA, 9 bp, Artificial Sequence
  Synthetic nucleic acid molecule
tgcagcgcc

SEQ ID NO: 2178 - DNA, 9 bp, Artificial Sequence
  Synthetic nucleic acid molecule
tgcagcgcc

SEQ ID NO: 2179 - DNA, 9 bp, Artificial Sequence
  Synthetic nucleic acid molecule
agcagggta

SEQ ID NO: 2180 - DNA, 9 bp, Artificial Sequence
  Synthetic nucleic acid molecule
agcagcggg

SEQ ID NO: 2181 - DNA, 9 bp, Artificial Sequence
  Synthetic nucleic acid molecule
agcaggttc

SEQ ID NO: 2182 - DNA, 9 bp, Artificial Sequence
  Synthetic nucleic acid molecule
ggcatcgtc

SEQ ID NO: 2183 - DNA, 9 bp, Artificial Sequence
  Synthetic nucleic acid molecule
aatagcgtc

SEQ ID NO: 2184 - DNA, 9 bp, Artificial Sequence
  Synthetic nucleic acid molecule
agcagcatg

SEQ ID NO: 2185 - DNA, 9 bp, Artificial Sequence
  Synthetic nucleic acid molecule
agcagcctg

SEQ ID NO: 2186 - DNA, 9 bp, Artificial Sequence
  Synthetic nucleic acid molecule
ggcagcgtg

SEQ ID NO: 2187 - DNA, 9 bp, Artificial Sequence
  Synthetic nucleic acid molecule
agcagagtt

SEQ ID NO: 2188 - DNA, 9 bp, Artificial Sequence
  Synthetic nucleic acid molecule
aacagagtc

SEQ ID NO: 2189 - DNA, 9 bp, Artificial Sequence
  Synthetic nucleic acid molecule
aacagcggc

SEQ ID NO: 2190 - DNA, 9 bp, Artificial Sequence
  Synthetic nucleic acid molecule
agcagggtg

SEQ ID NO: 2191 - DNA, 9 bp, Artificial Sequence
  Synthetic nucleic acid molecule
agctgcatc

SEQ ID NO: 2192 - DNA, 9 bp, Artificial Sequence
  Synthetic nucleic acid molecule
ggcagggtc

SEQ ID NO: 2193 - DNA, 9 bp, Artificial Sequence
  Synthetic nucleic acid molecule
agcagcttt

SEQ ID NO: 2194 - DNA, 9 bp, Artificial Sequence
  Synthetic nucleic acid molecule
agcagggcc

SEQ ID NO: 2195 - DNA, 9 bp, Artificial Sequence
  Synthetic nucleic acid molecule
agcagggcc

SEQ ID NO: 2196 - DNA, 9 bp, Artificial Sequence
  Synthetic nucleic acid molecule
ggcagcgtt

SEQ ID NO: 2197 - DNA, 9 bp, Artificial Sequence
  Synthetic nucleic acid molecule
aacagagtc

SEQ ID NO: 2198 - DNA, 9 bp, Artificial Sequence
  Synthetic nucleic acid molecule
agcagggcc

SEQ ID NO: 2199 - DNA, 9 bp, Artificial Sequence
  Synthetic nucleic acid molecule
gggagcgtc

SEQ ID NO: 2200 - DNA, 9 bp, Artificial Sequence
  Synthetic nucleic acid molecule
atcagtgtc

SEQ ID NO: 2201 - DNA, 9 bp, Artificial Sequence
  Synthetic nucleic acid molecule
agcggcttc

SEQ ID NO: 2202 - DNA, 9 bp, Artificial Sequence
  Synthetic nucleic acid molecule
agcaatgtc

SEQ ID NO: 2203 - DNA, 9 bp, Artificial Sequence
  Synthetic nucleic acid molecule
agcaaagtc

SEQ ID NO: 2204 - DNA, 9 bp, Artificial Sequence
  Synthetic nucleic acid molecule
agcaatgtc

SEQ ID NO: 2205 - DNA, 9 bp, Artificial Sequence
  Synthetic nucleic acid molecule
agcagggtg

SEQ ID NO: 2206 - DNA, 9 bp, Artificial Sequence
  Synthetic nucleic acid molecule
accagcctc

SEQ ID NO: 2207 - DNA, 9 bp, Artificial Sequence
  Synthetic nucleic acid molecule
agaagcggc

SEQ ID NO: 2208 - DNA, 9 bp, Artificial Sequence
  Synthetic nucleic acid molecule
agcagtgtg

SEQ ID NO: 2209 - DNA, 9 bp, Artificial Sequence
  Synthetic nucleic acid molecule
agcaatgtc

SEQ ID NO: 2210 - DNA, 9 bp, Artificial Sequence
  Synthetic nucleic acid molecule
agcagggtg

SEQ ID NO: 2211 - DNA, 9 bp, Artificial Sequence
  Synthetic nucleic acid molecule
agcagcatg

SEQ ID NO: 2212 - DNA, 9 bp, Artificial Sequence
  Synthetic nucleic acid molecule
agcagcttt

SEQ ID NO: 2213 - DNA, 9 bp, Artificial Sequence
  Synthetic nucleic acid molecule
agcaaggtc

SEQ ID NO: 2214 - DNA, 9 bp, Artificial Sequence
  Synthetic nucleic acid molecule
agcagcctg

SEQ ID NO: 2215 - DNA, 9 bp, Artificial Sequence
  Synthetic nucleic acid molecule
agcagtggc

SEQ ID NO: 2216 - DNA, 9 bp, Artificial Sequence
  Synthetic nucleic acid molecule
aacagcgtg

SEQ ID NO: 2217 - DNA, 9 bp, Artificial Sequence
  Synthetic nucleic acid molecule
agcatcctc

SEQ ID NO: 2218 - DNA, 9 bp, Artificial Sequence
  Synthetic nucleic acid molecule
agcagagcc

SEQ ID NO: 2219 - DNA, 9 bp, Artificial Sequence
  Synthetic nucleic acid molecule
agcagccgc

SEQ ID NO: 2220 - DNA, 9 bp, Artificial Sequence
  Synthetic nucleic acid molecule
agcagcgag

SEQ ID NO: 2221 - DNA, 9 bp, Artificial Sequence
  Synthetic nucleic acid molecule
agccgggtc

SEQ ID NO: 2222 - DNA, 9 bp, Artificial Sequence
  Synthetic nucleic acid molecule
agcctcgtc

SEQ ID NO: 2223 - DNA, 9 bp, Artificial Sequence
  Synthetic nucleic acid molecule
aggagagtc

SEQ ID NO: 2224 - DNA, 9 bp, Artificial Sequence
  Synthetic nucleic acid molecule
agcaatgtc

SEQ ID NO: 2225 - DNA, 9 bp, Artificial Sequence
  Synthetic nucleic acid molecule
agcatcggc

SEQ ID NO: 2226 - DNA, 9 bp, Artificial Sequence
  Synthetic nucleic acid molecule
agcatcttc

SEQ ID NO: 2227 - DNA, 9 bp, Artificial Sequence
  Synthetic nucleic acid molecule
ggcagcgtg

SEQ ID NO: 2228 - DNA, 9 bp, Artificial Sequence
  Synthetic nucleic acid molecule
agcagggta

SEQ ID NO: 2229 - DNA, 9 bp, Artificial Sequence
  Synthetic nucleic acid molecule
aacagagtc

SEQ ID NO: 2230 - DNA, 9 bp, Artificial Sequence
  Synthetic nucleic acid molecule
agcacagtc

SEQ ID NO: 2231 - DNA, 9 bp, Artificial Sequence
  Synthetic nucleic acid molecule
attagcgtc

SEQ ID NO: 2232 - DNA, 9 bp, Artificial Sequence
  Synthetic nucleic acid molecule
aacagagtc

SEQ ID NO: 2233 - DNA, 9 bp, Artificial Sequence
  Synthetic nucleic acid molecule
agcagcctg

SEQ ID NO: 2234 - DNA, 9 bp, Artificial Sequence
  Synthetic nucleic acid molecule
aacaccgtc

SEQ ID NO: 2235 - DNA, 9 bp, Artificial Sequence
  Synthetic nucleic acid molecule
agcagcgga

SEQ ID NO: 2236 - DNA, 9 bp, Artificial Sequence
  Synthetic nucleic acid molecule
ggcagcgtg

SEQ ID NO: 2237 - DNA, 9 bp, Artificial Sequence
  Synthetic nucleic acid molecule
aacaccgtc

SEQ ID NO: 2238 - DNA, 9 bp, Artificial Sequence
  Synthetic nucleic acid molecule
agcagcgat

SEQ ID NO: 2239 - DNA, 9 bp, Artificial Sequence
  Synthetic nucleic acid molecule
agcagggtg

SEQ ID NO: 2240 - DNA, 9 bp, Artificial Sequence
  Synthetic nucleic acid molecule
agctgggtc

SEQ ID NO: 2241 - DNA, 9 bp, Artificial Sequence
  Synthetic nucleic acid molecule
agcagctcc

SEQ ID NO: 2242 - DNA, 9 bp, Artificial Sequence
  Synthetic nucleic acid molecule
agcaatgtc

SEQ ID NO: 2243 - DNA, 9 bp, Artificial Sequence
  Synthetic nucleic acid molecule
agcacagtc

SEQ ID NO: 2244 - DNA, 9 bp, Artificial Sequence
  Synthetic nucleic acid molecule
agcagcgga

SEQ ID NO: 2245 - DNA, 9 bp, Artificial Sequence
  Synthetic nucleic acid molecule
agcagcttt

SEQ ID NO: 2246 - DNA, 9 bp, Artificial Sequence
  Synthetic nucleic acid molecule
agcagcgat

SEQ ID NO: 2247 - DNA, 9 bp, Artificial Sequence
  Synthetic nucleic acid molecule
agcagcagc

SEQ ID NO: 2248 - DNA, 9 bp, Artificial Sequence
  Synthetic nucleic acid molecule
aggagcggc

SEQ ID NO: 2249 - DNA, 9 bp, Artificial Sequence
  Synthetic nucleic acid molecule
agcacggtc

SEQ ID NO: 2250 - DNA, 9 bp, Artificial Sequence
  Synthetic nucleic acid molecule
agctgggtc

SEQ ID NO: 2251 - DNA, 9 bp, Artificial Sequence
  Synthetic nucleic acid molecule
agctgagtc

SEQ ID NO: 2252 - DNA, 9 bp, Artificial Sequence
  Synthetic nucleic acid molecule
agtagggtc

SEQ ID NO: 2253 - DNA, 9 bp, Artificial Sequence
  Synthetic nucleic acid molecule
agtagagtc

SEQ ID NO: 2254 - DNA, 9 bp, Artificial Sequence
  Synthetic nucleic acid molecule
aggagagtc

SEQ ID NO: 2255 - DNA, 9 bp, Artificial Sequence
  Synthetic nucleic acid molecule
agcgccgtc

SEQ ID NO: 2256 - DNA, 9 bp, Artificial Sequence
  Synthetic nucleic acid molecule
agctgtgtc

SEQ ID NO: 2257 - DNA, 9 bp, Artificial Sequence
  Synthetic nucleic acid molecule
agctgcctc

SEQ ID NO: 2258 - DNA, 9 bp, Artificial Sequence
  Synthetic nucleic acid molecule
agcagcctg

SEQ ID NO: 2259 - DNA, 9 bp, Artificial Sequence
  Synthetic nucleic acid molecule
agcagcctg

SEQ ID NO: 2260 - DNA, 9 bp, Artificial Sequence
  Synthetic nucleic acid molecule
ggcagagtc

SEQ ID NO: 2261 - DNA, 9 bp, Artificial Sequence
  Synthetic nucleic acid molecule
agcattgtc

SEQ ID NO: 2262 - DNA, 9 bp, Artificial Sequence
  Synthetic nucleic acid molecule
agcagggtg

SEQ ID NO: 2263 - DNA, 9 bp, Artificial Sequence
  Synthetic nucleic acid molecule
ggcagggtc

SEQ ID NO: 2264 - DNA, 9 bp, Artificial Sequence
  Synthetic nucleic acid molecule
agtagagtc

SEQ ID NO: 2265 - DNA, 9 bp, Artificial Sequence
  Synthetic nucleic acid molecule
agcagggcc

SEQ ID NO: 2266 - DNA, 9 bp, Artificial Sequence
  Synthetic nucleic acid molecule
agcaaagtc

SEQ ID NO: 2267 - DNA, 9 bp, Artificial Sequence
  Synthetic nucleic acid molecule
agcagtgcc

SEQ ID NO: 2268 - DNA, 9 bp, Artificial Sequence
  Synthetic nucleic acid molecule
ggcagggtc

SEQ ID NO: 2269 - DNA, 9 bp, Artificial Sequence
  Synthetic nucleic acid molecule
agctgggtc

SEQ ID NO: 2270 - DNA, 9 bp, Artificial Sequence
  Synthetic nucleic acid molecule
agcagcttt

SEQ ID NO: 2271 - DNA, 9 bp, Artificial Sequence
  Synthetic nucleic acid molecule
atcatcgtc

SEQ ID NO: 2272 - DNA, 9 bp, Artificial Sequence
  Synthetic nucleic acid molecule
agccgcgtg

SEQ ID NO: 2273 - DNA, 9 bp, Artificial Sequence
  Synthetic nucleic acid molecule
agcagggtg

SEQ ID NO: 2274 - DNA, 9 bp, Artificial Sequence
  Synthetic nucleic acid molecule
agcatggtc

SEQ ID NO: 2275 - DNA, 9 bp, Artificial Sequence
  Synthetic nucleic acid molecule
atcagagtc

SEQ ID NO: 2276 - DNA, 9 bp, Artificial Sequence
  Synthetic nucleic acid molecule
agcagtggc

SEQ ID NO: 2277 - DNA, 9 bp, Artificial Sequence
  Synthetic nucleic acid molecule
aggagtgtc

SEQ ID NO: 2278 - DNA, 9 bp, Artificial Sequence
  Synthetic nucleic acid molecule
tgcagggtc

SEQ ID NO: 2279 - DNA, 9 bp, Artificial Sequence
  Synthetic nucleic acid molecule
agcaggttc

SEQ ID NO: 2280 - DNA, 9 bp, Artificial Sequence
  Synthetic nucleic acid molecule
agcagcgga

SEQ ID NO: 2281 - DNA, 9 bp, Artificial Sequence
  Synthetic nucleic acid molecule
agcagggtg

SEQ ID NO: 2282 - DNA, 9 bp, Artificial Sequence
  Synthetic nucleic acid molecule
agcaacctc

SEQ ID NO: 2283 - DNA, 9 bp, Artificial Sequence
  Synthetic nucleic acid molecule
agcagggtg

SEQ ID NO: 2284 - DNA, 9 bp, Artificial Sequence
  Synthetic nucleic acid molecule
agcaacctc

SEQ ID NO: 2285 - DNA, 9 bp, Artificial Sequence
  Synthetic nucleic acid molecule
tgcagggtc

SEQ ID NO: 2286 - DNA, 9 bp, Artificial Sequence
  Synthetic nucleic acid molecule
agcaggttc

SEQ ID NO: 2287 - DNA, 9 bp, Artificial Sequence
  Synthetic nucleic acid molecule
agcaatgtc

SEQ ID NO: 2288 - DNA, 9 bp, Artificial Sequence
  Synthetic nucleic acid molecule
agcacggtc

SEQ ID NO: 2289 - DNA, 9 bp, Artificial Sequence
  Synthetic nucleic acid molecule
agcagcgct

SEQ ID NO: 2290 - DNA, 9 bp, Artificial Sequence
  Synthetic nucleic acid molecule
agcagggac

SEQ ID NO: 2291 - DNA, 9 bp, Artificial Sequence
  Synthetic nucleic acid molecule
agcagccac

SEQ ID NO: 2292 - DNA, 9 bp, Artificial Sequence
  Synthetic nucleic acid molecule
agtagagtc

SEQ ID NO: 2293 - DNA, 9 bp, Artificial Sequence
  Synthetic nucleic acid molecule
agcctcgtc

SEQ ID NO: 2294 - DNA, 9 bp, Artificial Sequence
  Synthetic nucleic acid molecule
ggcagcggc

SEQ ID NO: 2295 - DNA, 9 bp, Artificial Sequence
  Synthetic nucleic acid molecule
agcagagtt

SEQ ID NO: 2296 - DNA, 9 bp, Artificial Sequence
  Synthetic nucleic acid molecule
agcatcttc

SEQ ID NO: 2297 - DNA, 9 bp, Artificial Sequence
  Synthetic nucleic acid molecule
agcaacatc

SEQ ID NO: 2298 - DNA, 9 bp, Artificial Sequence
  Synthetic nucleic acid molecule
agcacagtc

SEQ ID NO: 2299 - DNA, 9 bp, Artificial Sequence
  Synthetic nucleic acid molecule
aggagtttc

SEQ ID NO: 2300 - DNA, 9 bp, Artificial Sequence
  Synthetic nucleic acid molecule
ggcagcagc

SEQ ID NO: 2301 - DNA, 9 bp, Artificial Sequence
  Synthetic nucleic acid molecule
agcaggttg

SEQ ID NO: 2302 - DNA, 9 bp, Artificial Sequence
  Synthetic nucleic acid molecule
aacagtgcc

SEQ ID NO: 2303 - DNA, 9 bp, Artificial Sequence
  Synthetic nucleic acid molecule
tggagcgtg

SEQ ID NO: 2304 - DNA, 9 bp, Artificial Sequence
  Synthetic nucleic acid molecule
tggagcgtg

SEQ ID NO: 2305 - DNA, 9 bp, Artificial Sequence
  Synthetic nucleic acid molecule
agctgaggc

SEQ ID NO: 2306 - DNA, 9 bp, Artificial Sequence
  Synthetic nucleic acid molecule
tgcagggtg

SEQ ID NO: 2307 - DNA, 9 bp, Artificial Sequence
  Synthetic nucleic acid molecule
aacagagtg

SEQ ID NO: 2308 - DNA, 9 bp, Artificial Sequence
  Synthetic nucleic acid molecule
agcaactta

SEQ ID NO: 2309 - DNA, 9 bp, Artificial Sequence
  Synthetic nucleic acid molecule
agcacaatc

SEQ ID NO: 2310 - DNA, 9 bp, Artificial Sequence
  Synthetic nucleic acid molecule
tggagggtc

SEQ ID NO: 2311 - DNA, 9 bp, Artificial Sequence
  Synthetic nucleic acid molecule
agccgtgtg

SEQ ID NO: 2312 - DNA, 9 bp, Artificial Sequence
  Synthetic nucleic acid molecule
tgctgcttc

SEQ ID NO: 2313 - DNA, 9 bp, Artificial Sequence
  Synthetic nucleic acid molecule
aacagagta

SEQ ID NO: 2314 - DNA, 9 bp, Artificial Sequence
  Synthetic nucleic acid molecule
accaacttc

SEQ ID NO: 2315 - DNA, 9 bp, Artificial Sequence
  Synthetic nucleic acid molecule
aggagagtg

SEQ ID NO: 2316 - DNA, 9 bp, Artificial Sequence
  Synthetic nucleic acid molecule
ggcagggtg

SEQ ID NO: 2317 - DNA, 9 bp, Artificial Sequence
  Synthetic nucleic acid molecule
ggcagggtg

SEQ ID NO: 2318 - DNA, 9 bp, Artificial Sequence
  Synthetic nucleic acid molecule
agcagggct

SEQ ID NO: 2319 - DNA, 9 bp, Artificial Sequence
  Synthetic nucleic acid molecule
tacagtgtc

SEQ ID NO: 2320 - DNA, 9 bp, Artificial Sequence
  Synthetic nucleic acid molecule
atcaccttc

SEQ ID NO: 2321 - DNA, 9 bp, Artificial Sequence
  Synthetic nucleic acid molecule
ttcagtgtc

SEQ ID NO: 2322 - DNA, 9 bp, Artificial Sequence
  Synthetic nucleic acid molecule
agcagctca

SEQ ID NO: 2323 - DNA, 9 bp, Artificial Sequence
  Synthetic nucleic acid molecule
aggagagta

SEQ ID NO: 2324 - DNA, 9 bp, Artificial Sequence
  Synthetic nucleic acid molecule
acctgggtc

SEQ ID NO: 2325 - DNA, 9 bp, Artificial Sequence
  Synthetic nucleic acid molecule
atcagtgtg

SEQ ID NO: 2326 - DNA, 9 bp, Artificial Sequence
  Synthetic nucleic acid molecule
tggagggtc

SEQ ID NO: 2327 - DNA, 9 bp, Artificial Sequence
  Synthetic nucleic acid molecule
ggcagggtg

SEQ ID NO: 2328 - DNA, 9 bp, Artificial Sequence
  Synthetic nucleic acid molecule
aggagagtg

SEQ ID NO: 2329 - DNA, 9 bp, Artificial Sequence
  Synthetic nucleic acid molecule
agcagtgca

SEQ ID NO: 2330 - DNA, 9 bp, Artificial Sequence
  Synthetic nucleic acid molecule
agcaggttg

SEQ ID NO: 2331 - DNA, 9 bp, Artificial Sequence
  Synthetic nucleic acid molecule
aggagagtg

SEQ ID NO: 2332 - DNA, 9 bp, Artificial Sequence
  Synthetic nucleic acid molecule
agcagccgt

SEQ ID NO: 2333 - DNA, 9 bp, Artificial Sequence
  Synthetic nucleic acid molecule
agcagggca

SEQ ID NO: 2334 - DNA, 9 bp, Artificial Sequence
  Synthetic nucleic acid molecule
gccagcctc

SEQ ID NO: 2335 - DNA, 9 bp, Artificial Sequence
  Synthetic nucleic acid molecule
agcagggct

SEQ ID NO: 2336 - DNA, 9 bp, Artificial Sequence
  Synthetic nucleic acid molecule
agtagcaac

SEQ ID NO: 2337 - DNA, 9 bp, Artificial Sequence
  Synthetic nucleic acid molecule
aacagcgga

SEQ ID NO: 2338 - DNA, 9 bp, Artificial Sequence
  Synthetic nucleic acid molecule
aggaccatc

SEQ ID NO: 2339 - DNA, 9 bp, Artificial Sequence
  Synthetic nucleic acid molecule
aggaccatc

SEQ ID NO: 2340 - DNA, 9 bp, Artificial Sequence
  Synthetic nucleic acid molecule
aggaccatc

SEQ ID NO: 2341 - DNA, 9 bp, Artificial Sequence
  Synthetic nucleic acid molecule
aggaccatc

SEQ ID NO: 2342 - DNA, 9 bp, Artificial Sequence
  Synthetic nucleic acid molecule
agcaggtta

SEQ ID NO: 2343 - DNA, 9 bp, Artificial Sequence
  Synthetic nucleic acid molecule
tgcagggtg

SEQ ID NO: 2344 - DNA, 9 bp, Artificial Sequence
  Synthetic nucleic acid molecule
agaagggta

SEQ ID NO: 2345 - DNA, 9 bp, Artificial Sequence
  Synthetic nucleic acid molecule
agatgcggc

SEQ ID NO: 2346 - DNA, 9 bp, Artificial Sequence
  Synthetic nucleic acid molecule
aatagggtc

SEQ ID NO: 2347 - DNA, 9 bp, Artificial Sequence
  Synthetic nucleic acid molecule
agcagtgaa

SEQ ID NO: 2348 - DNA, 9 bp, Artificial Sequence
  Synthetic nucleic acid molecule
agaaacgtg

SEQ ID NO: 2349 - DNA, 9 bp, Artificial Sequence
  Synthetic nucleic acid molecule
aacagggac

SEQ ID NO: 2350 - DNA, 9 bp, Artificial Sequence
  Synthetic nucleic acid molecule
agcaaggac

SEQ ID NO: 2351 - DNA, 9 bp, Artificial Sequence
  Synthetic nucleic acid molecule
agcagatgc

SEQ ID NO: 2352 - DNA, 9 bp, Artificial Sequence
  Synthetic nucleic acid molecule
agcagctgt

SEQ ID NO: 2353 - DNA, 9 bp, Artificial Sequence
  Synthetic nucleic acid molecule
agaagggtt

SEQ ID NO: 2354 - DNA, 9 bp, Artificial Sequence
  Synthetic nucleic acid molecule
aacagagtg

SEQ ID NO: 2355 - DNA, 9 bp, Artificial Sequence
  Synthetic nucleic acid molecule
ggcagtggc

SEQ ID NO: 2356 - DNA, 9 bp, Artificial Sequence
  Synthetic nucleic acid molecule
agcaccgag

SEQ ID NO: 2357 - DNA, 9 bp, Artificial Sequence
  Synthetic nucleic acid molecule
atcagcatg

SEQ ID NO: 2358 - DNA, 9 bp, Artificial Sequence
  Synthetic nucleic acid molecule
agctgtgtg

SEQ ID NO: 2359 - DNA, 9 bp, Artificial Sequence
  Synthetic nucleic acid molecule
tgcagggtg

SEQ ID NO: 2360 - DNA, 9 bp, Artificial Sequence
  Synthetic nucleic acid molecule
tgcagggtg

SEQ ID NO: 2361 - DNA, 9 bp, Artificial Sequence
  Synthetic nucleic acid molecule
aggaggttc

SEQ ID NO: 2362 - DNA, 9 bp, Artificial Sequence
  Synthetic nucleic acid molecule
aggaatgtc

SEQ ID NO: 2363 - DNA, 9 bp, Artificial Sequence
  Synthetic nucleic acid molecule
agtagctgc

SEQ ID NO: 2364 - DNA, 9 bp, Artificial Sequence
  Synthetic nucleic acid molecule
agaagggtg

SEQ ID NO: 2365 - DNA, 9 bp, Artificial Sequence
  Synthetic nucleic acid molecule
agtagctgc

SEQ ID NO: 2366 - DNA, 9 bp, Artificial Sequence
  Synthetic nucleic acid molecule
agtagctgc

SEQ ID NO: 2367 - DNA, 9 bp, Artificial Sequence
  Synthetic nucleic acid molecule
agtagctgc

SEQ ID NO: 2368 - DNA, 9 bp, Artificial Sequence
  Synthetic nucleic acid molecule
agtagctgc

SEQ ID NO: 2369 - DNA, 9 bp, Artificial Sequence
  Synthetic nucleic acid molecule
agtagctgc

SEQ ID NO: 2370 - DNA, 9 bp, Artificial Sequence
  Synthetic nucleic acid molecule
agtagctgc

SEQ ID NO: 2371 - DNA, 9 bp, Artificial Sequence
  Synthetic nucleic acid molecule
agtagctgc

SEQ ID NO: 2372 - DNA, 9 bp, Artificial Sequence
  Synthetic nucleic acid molecule
agtagaggc

SEQ ID NO: 2373 - DNA, 9 bp, Artificial Sequence
  Synthetic nucleic acid molecule
ggcagcagc

SEQ ID NO: 2374 - DNA, 9 bp, Artificial Sequence
  Synthetic nucleic acid molecule
agcagcaca

SEQ ID NO: 2375 - DNA, 9 bp, Artificial Sequence
  Synthetic nucleic acid molecule
tgcatcgta

SEQ ID NO: 2376 - DNA, 9 bp, Artificial Sequence
  Synthetic nucleic acid molecule
ggcagggtg

SEQ ID NO: 2377 - DNA, 9 bp, Artificial Sequence
  Synthetic nucleic acid molecule
agcagctga

SEQ ID NO: 2378 - DNA, 9 bp, Artificial Sequence
  Synthetic nucleic acid molecule
tggagcgtg

SEQ ID NO: 2379 - DNA, 9 bp, Artificial Sequence
  Synthetic nucleic acid molecule
tccagggtc

SEQ ID NO: 2380 - DNA, 9 bp, Artificial Sequence
  Synthetic nucleic acid molecule
tgcagcgaa

SEQ ID NO: 2381 - DNA, 9 bp, Artificial Sequence
  Synthetic nucleic acid molecule
agcaggttg

SEQ ID NO: 2382 - DNA, 9 bp, Artificial Sequence
  Synthetic nucleic acid molecule
agctgaggc

SEQ ID NO: 2383 - DNA, 9 bp, Artificial Sequence
  Synthetic nucleic acid molecule
aacagtggc

SEQ ID NO: 2384 - DNA, 9 bp, Artificial Sequence
  Synthetic nucleic acid molecule
ggcagtgcc

SEQ ID NO: 2385 - DNA, 9 bp, Artificial Sequence
  Synthetic nucleic acid molecule
ggcagtgcc

SEQ ID NO: 2386 - DNA, 9 bp, Artificial Sequence
  Synthetic nucleic acid molecule
ggcagtgcc

SEQ ID NO: 2387 - DNA, 9 bp, Artificial Sequence
  Synthetic nucleic acid molecule
aggagagta

SEQ ID NO: 2388 - DNA, 9 bp, Artificial Sequence
  Synthetic nucleic acid molecule
cgcagcatt

SEQ ID NO: 2389 - DNA, 9 bp, Artificial Sequence
  Synthetic nucleic acid molecule
ggaagtgtc

SEQ ID NO: 2390 - DNA, 9 bp, Artificial Sequence
  Synthetic nucleic acid molecule
agctgcata

SEQ ID NO: 2391 - DNA, 9 bp, Artificial Sequence
  Synthetic nucleic acid molecule
actagggtc

SEQ ID NO: 2392 - DNA, 9 bp, Artificial Sequence
  Synthetic nucleic acid molecule
agctgtgtg

SEQ ID NO: 2393 - DNA, 9 bp, Artificial Sequence
  Synthetic nucleic acid molecule
accactgtc

SEQ ID NO: 2394 - DNA, 9 bp, Artificial Sequence
  Synthetic nucleic acid molecule
ggtagcttc

SEQ ID NO: 2395 - DNA, 9 bp, Artificial Sequence
  Synthetic nucleic acid molecule
agcagggct

SEQ ID NO: 2396 - DNA, 9 bp, Artificial Sequence
  Synthetic nucleic acid molecule
agctgtgtg

SEQ ID NO: 2397 - DNA, 9 bp, Artificial Sequence
  Synthetic nucleic acid molecule
tgaagagtc

SEQ ID NO: 2398 - DNA, 9 bp, Artificial Sequence
  Synthetic nucleic acid molecule
tgaagagtc

SEQ ID NO: 2399 - DNA, 9 bp, Artificial Sequence
  Synthetic nucleic acid molecule
acgagggtc

SEQ ID NO: 2400 - DNA, 9 bp, Artificial Sequence
  Synthetic nucleic acid molecule
agaagcggt

SEQ ID NO: 2401 - DNA, 9 bp, Artificial Sequence
  Synthetic nucleic acid molecule
ggcagagtt

SEQ ID NO: 2402 - DNA, 9 bp, Artificial Sequence
  Synthetic nucleic acid molecule
agcagttac

SEQ ID NO: 2403 - DNA, 9 bp, Artificial Sequence
  Synthetic nucleic acid molecule
tgcagtgtg

SEQ ID NO: 2404 - DNA, 9 bp, Artificial Sequence
  Synthetic nucleic acid molecule
ctctgcgtc

SEQ ID NO: 2405 - DNA, 9 bp, Artificial Sequence
  Synthetic nucleic acid molecule
aggagagtg

SEQ ID NO: 2406 - DNA, 9 bp, Artificial Sequence
  Synthetic nucleic acid molecule
aggagagtg

SEQ ID NO: 2407 - DNA, 9 bp, Artificial Sequence
  Synthetic nucleic acid molecule
aatagggtc

SEQ ID NO: 2408 - DNA, 9 bp, Artificial Sequence
  Synthetic nucleic acid molecule
agcagcgtc

SEQ ID NO: 2409 - DNA, 9 bp, Artificial Sequence
  Synthetic nucleic acid molecule
agcagcgtc

SEQ ID NO: 2410 - DNA, 9 bp, Artificial Sequence
  Synthetic nucleic acid molecule
agcagcgtc

SEQ ID NO: 2411 - DNA, 9 bp, Artificial Sequence
  Synthetic nucleic acid molecule
agcagcgtc

SEQ ID NO: 2412 - DNA, 9 bp, Artificial Sequence
  Synthetic nucleic acid molecule
agcagcgtc

SEQ ID NO: 2413 - DNA, 9 bp, Artificial Sequence
  Synthetic nucleic acid molecule
agcagcgtc

SEQ ID NO: 2414 - DNA, 9 bp, Artificial Sequence
  Synthetic nucleic acid molecule
agcagcgtc

SEQ ID NO: 2415 - DNA, 9 bp, Artificial Sequence
  Synthetic nucleic acid molecule
agcagcgtc

SEQ ID NO: 2416 - DNA, 9 bp, Artificial Sequence
  Synthetic nucleic acid molecule
agcagcgtc

SEQ ID NO: 2417 - DNA, 9 bp, Artificial Sequence
  Synthetic nucleic acid molecule
agcagcgtc

SEQ ID NO: 2418 - DNA, 9 bp, Artificial Sequence
  Synthetic nucleic acid molecule
agcagcgtc

SEQ ID NO: 2419 - DNA, 9 bp, Artificial Sequence
  Synthetic nucleic acid molecule
agcagcgtc

SEQ ID NO: 2420 - DNA, 9 bp, Artificial Sequence
  Synthetic nucleic acid molecule
agcagcgtc

SEQ ID NO: 2421 - DNA, 9 bp, Artificial Sequence
  Synthetic nucleic acid molecule
agcagcgtc

SEQ ID NO: 2422 - DNA, 9 bp, Artificial Sequence
  Synthetic nucleic acid molecule
agcagcgtc

SEQ ID NO: 2423 - DNA, 9 bp, Artificial Sequence
  Synthetic nucleic acid molecule
agcagcgtc

SEQ ID NO: 2424 - DNA, 9 bp, Artificial Sequence
  Synthetic nucleic acid molecule
agcagcgtc

SEQ ID NO: 2425 - DNA, 9 bp, Artificial Sequence
  Synthetic nucleic acid molecule
agcagcgtc

SEQ ID NO: 2426 - DNA, 9 bp, Artificial Sequence
  Synthetic nucleic acid molecule
agcagcgtc

SEQ ID NO: 2427 - DNA, 9 bp, Artificial Sequence
  Synthetic nucleic acid molecule
agcagcgtc

SEQ ID NO: 2428 - DNA, 9 bp, Artificial Sequence
  Synthetic nucleic acid molecule
agcagcgtc

SEQ ID NO: 2429 - DNA, 9 bp, Artificial Sequence
  Synthetic nucleic acid molecule
agcagcgtc

SEQ ID NO: 2430 - DNA, 9 bp, Artificial Sequence
  Synthetic nucleic acid molecule
agcagcgtc

SEQ ID NO: 2431 - DNA, 9 bp, Artificial Sequence
  Synthetic nucleic acid molecule
agcagcgtc

SEQ ID NO: 2432 - DNA, 9 bp, Artificial Sequence
  Synthetic nucleic acid molecule
agcagcgtc

SEQ ID NO: 2433 - DNA, 9 bp, Artificial Sequence
  Synthetic nucleic acid molecule
agcagcgtc

SEQ ID NO: 2434 - DNA, 9 bp, Artificial Sequence
  Synthetic nucleic acid molecule
agccgcgtc

SEQ ID NO: 2435 - DNA, 9 bp, Artificial Sequence
  Synthetic nucleic acid molecule
agcagtgtc

SEQ ID NO: 2436 - DNA, 9 bp, Artificial Sequence
  Synthetic nucleic acid molecule
agcagtgtc

SEQ ID NO: 2437 - DNA, 9 bp, Artificial Sequence
  Synthetic nucleic acid molecule
agcatcgtc

SEQ ID NO: 2438 - DNA, 9 bp, Artificial Sequence
  Synthetic nucleic acid molecule
agcagcggc

SEQ ID NO: 2439 - DNA, 9 bp, Artificial Sequence
  Synthetic nucleic acid molecule
agcaacgtc

SEQ ID NO: 2440 - DNA, 9 bp, Artificial Sequence
  Synthetic nucleic acid molecule
agcagtgtc

SEQ ID NO: 2441 - DNA, 9 bp, Artificial Sequence
  Synthetic nucleic acid molecule
agcagcggc

SEQ ID NO: 2442 - DNA, 9 bp, Artificial Sequence
  Synthetic nucleic acid molecule
agcaacgtc

SEQ ID NO: 2443 - DNA, 9 bp, Artificial Sequence
  Synthetic nucleic acid molecule
agcaacgtc

SEQ ID NO: 2444 - DNA, 9 bp, Artificial Sequence
  Synthetic nucleic acid molecule
agtagcgtc

SEQ ID NO: 2445 - DNA, 9 bp, Artificial Sequence
  Synthetic nucleic acid molecule
agcaacgtc

SEQ ID NO: 2446 - DNA, 9 bp, Artificial Sequence
  Synthetic nucleic acid molecule
agcagcgtt

SEQ ID NO: 2447 - DNA, 9 bp, Artificial Sequence
  Synthetic nucleic acid molecule
agcagtgtc

SEQ ID NO: 2448 - DNA, 9 bp, Artificial Sequence
  Synthetic nucleic acid molecule
agcaacgtc

SEQ ID NO: 2449 - DNA, 9 bp, Artificial Sequence
  Synthetic nucleic acid molecule
agcaacgtc

SEQ ID NO: 2450 - DNA, 9 bp, Artificial Sequence
  Synthetic nucleic acid molecule
ggcagcgtc

SEQ ID NO: 2451 - DNA, 9 bp, Artificial Sequence
  Synthetic nucleic acid molecule
agcaacgtc

SEQ ID NO: 2452 - DNA, 9 bp, Artificial Sequence
  Synthetic nucleic acid molecule
agcagagtc

SEQ ID NO: 2453 - DNA, 9 bp, Artificial Sequence
  Synthetic nucleic acid molecule
agcagcggc

SEQ ID NO: 2454 - DNA, 9 bp, Artificial Sequence
  Synthetic nucleic acid molecule
agcagtgtc

SEQ ID NO: 2455 - DNA, 9 bp, Artificial Sequence
  Synthetic nucleic acid molecule
agcatcgtc

SEQ ID NO: 2456 - DNA, 9 bp, Artificial Sequence
  Synthetic nucleic acid molecule
agcaacgtc

SEQ ID NO: 2457 - DNA, 9 bp, Artificial Sequence
  Synthetic nucleic acid molecule
agcaacgtc

SEQ ID NO: 2458 - DNA, 9 bp, Artificial Sequence
  Synthetic nucleic acid molecule
agcagggtc

SEQ ID NO: 2459 - DNA, 9 bp, Artificial Sequence
  Synthetic nucleic acid molecule
accagcgtc

SEQ ID NO: 2460 - DNA, 9 bp, Artificial Sequence
  Synthetic nucleic acid molecule
agcaacgtc

SEQ ID NO: 2461 - DNA, 9 bp, Artificial Sequence
  Synthetic nucleic acid molecule
agcagcatc

SEQ ID NO: 2462 - DNA, 9 bp, Artificial Sequence
  Synthetic nucleic acid molecule
agcagcggc

SEQ ID NO: 2463 - DNA, 9 bp, Artificial Sequence
  Synthetic nucleic acid molecule
agcagtgtc

SEQ ID NO: 2464 - DNA, 9 bp, Artificial Sequence
  Synthetic nucleic acid molecule
agcaacgtc

SEQ ID NO: 2465 - DNA, 9 bp, Artificial Sequence
  Synthetic nucleic acid molecule
agcagcggc

SEQ ID NO: 2466 - DNA, 9 bp, Artificial Sequence
  Synthetic nucleic acid molecule
agcagcggc

SEQ ID NO: 2467 - DNA, 9 bp, Artificial Sequence
  Synthetic nucleic acid molecule
agcagtgtc

SEQ ID NO: 2468 - DNA, 9 bp, Artificial Sequence
  Synthetic nucleic acid molecule
agcaacgtc

SEQ ID NO: 2469 - DNA, 9 bp, Artificial Sequence
  Synthetic nucleic acid molecule
agcagagtc

SEQ ID NO: 2470 - DNA, 9 bp, Artificial Sequence
  Synthetic nucleic acid molecule
agcagtgtc

SEQ ID NO: 2471 - DNA, 9 bp, Artificial Sequence
  Synthetic nucleic acid molecule
agcagtgtc

SEQ ID NO: 2472 - DNA, 9 bp, Artificial Sequence
  Synthetic nucleic acid molecule
tgcagcgtc

SEQ ID NO: 2473 - DNA, 9 bp, Artificial Sequence
  Synthetic nucleic acid molecule
ggcagcgtc

SEQ ID NO: 2474 - DNA, 9 bp, Artificial Sequence
  Synthetic nucleic acid molecule
agcagcgtg

SEQ ID NO: 2475 - DNA, 9 bp, Artificial Sequence
  Synthetic nucleic acid molecule
agcagcggc

SEQ ID NO: 2476 - DNA, 9 bp, Artificial Sequence
  Synthetic nucleic acid molecule
agcagtgtc

SEQ ID NO: 2477 - DNA, 9 bp, Artificial Sequence
  Synthetic nucleic acid molecule
agcagtgtc

SEQ ID NO: 2478 - DNA, 9 bp, Artificial Sequence
  Synthetic nucleic acid molecule
accagcgtc

SEQ ID NO: 2479 - DNA, 9 bp, Artificial Sequence
  Synthetic nucleic acid molecule
agcaacgtc

SEQ ID NO: 2480 - DNA, 9 bp, Artificial Sequence
  Synthetic nucleic acid molecule
agcaacgtc

SEQ ID NO: 2481 - DNA, 9 bp, Artificial Sequence
  Synthetic nucleic acid molecule
agcaacgtc

SEQ ID NO: 2482 - DNA, 9 bp, Artificial Sequence
  Synthetic nucleic acid molecule
agcaacgtc

SEQ ID NO: 2483 - DNA, 9 bp, Artificial Sequence
  Synthetic nucleic acid molecule
agcagtgtc

SEQ ID NO: 2484 - DNA, 9 bp, Artificial Sequence
  Synthetic nucleic acid molecule
agcagcggc

SEQ ID NO: 2485 - DNA, 9 bp, Artificial Sequence
  Synthetic nucleic acid molecule
agcagtgtc

SEQ ID NO: 2486 - DNA, 9 bp, Artificial Sequence
  Synthetic nucleic acid molecule
agcagcggc

SEQ ID NO: 2487 - DNA, 9 bp, Artificial Sequence
  Synthetic nucleic acid molecule
agcaacgtc

SEQ ID NO: 2488 - DNA, 9 bp, Artificial Sequence
  Synthetic nucleic acid molecule
agcagagtc

SEQ ID NO: 2489 - DNA, 9 bp, Artificial Sequence
  Synthetic nucleic acid molecule
agcagtgtc

SEQ ID NO: 2490 - DNA, 9 bp, Artificial Sequence
  Synthetic nucleic acid molecule
agcaccgtc

SEQ ID NO: 2491 - DNA, 9 bp, Artificial Sequence
  Synthetic nucleic acid molecule
accagcgtc

SEQ ID NO: 2492 - DNA, 9 bp, Artificial Sequence
  Synthetic nucleic acid molecule
agcaacgtc

SEQ ID NO: 2493 - DNA, 9 bp, Artificial Sequence
  Synthetic nucleic acid molecule
agcaacgtc

SEQ ID NO: 2494 - DNA, 9 bp, Artificial Sequence
  Synthetic nucleic acid molecule
agcaacgtc

SEQ ID NO: 2495 - DNA, 9 bp, Artificial Sequence
  Synthetic nucleic acid molecule
agcagggtc

SEQ ID NO: 2496 - DNA, 9 bp, Artificial Sequence
  Synthetic nucleic acid molecule
agcagtgtc

SEQ ID NO: 2497 - DNA, 9 bp, Artificial Sequence
  Synthetic nucleic acid molecule
agcaacgtc

SEQ ID NO: 2498 - DNA, 9 bp, Artificial Sequence
  Synthetic nucleic acid molecule
agcaacgtc

SEQ ID NO: 2499 - DNA, 9 bp, Artificial Sequence
  Synthetic nucleic acid molecule
agcagtgtc

SEQ ID NO: 2500 - DNA, 9 bp, Artificial Sequence
  Synthetic nucleic acid molecule
agcagcggc

SEQ ID NO: 2501 - DNA, 9 bp, Artificial Sequence
  Synthetic nucleic acid molecule
agcaacgtc

SEQ ID NO: 2502 - DNA, 9 bp, Artificial Sequence
  Synthetic nucleic acid molecule
agcaacgtc

SEQ ID NO: 2503 - DNA, 9 bp, Artificial Sequence
  Synthetic nucleic acid molecule
agcagcttc

SEQ ID NO: 2504 - DNA, 9 bp, Artificial Sequence
  Synthetic nucleic acid molecule
agcagtgtc

SEQ ID NO: 2505 - DNA, 9 bp, Artificial Sequence
  Synthetic nucleic acid molecule
agcatcgtc

SEQ ID NO: 2506 - DNA, 9 bp, Artificial Sequence
  Synthetic nucleic acid molecule
agcagcggc

SEQ ID NO: 2507 - DNA, 9 bp, Artificial Sequence
  Synthetic nucleic acid molecule
agcatcgtc

SEQ ID NO: 2508 - DNA, 9 bp, Artificial Sequence
  Synthetic nucleic acid molecule
agcagcgtt

SEQ ID NO: 2509 - DNA, 9 bp, Artificial Sequence
  Synthetic nucleic acid molecule
agcagcggc

SEQ ID NO: 2510 - DNA, 9 bp, Artificial Sequence
  Synthetic nucleic acid molecule
aacagcgtc

SEQ ID NO: 2511 - DNA, 9 bp, Artificial Sequence
  Synthetic nucleic acid molecule
agcatcgtc

SEQ ID NO: 2512 - DNA, 9 bp, Artificial Sequence
  Synthetic nucleic acid molecule
agcatcgtc

SEQ ID NO: 2513 - DNA, 9 bp, Artificial Sequence
  Synthetic nucleic acid molecule
agcatcgtc

SEQ ID NO: 2514 - DNA, 9 bp, Artificial Sequence
  Synthetic nucleic acid molecule
agcatcgtc

SEQ ID NO: 2515 - DNA, 9 bp, Artificial Sequence
  Synthetic nucleic acid molecule
agcagcatc

SEQ ID NO: 2516 - DNA, 9 bp, Artificial Sequence
  Synthetic nucleic acid molecule
agcaacgtc

SEQ ID NO: 2517 - DNA, 9 bp, Artificial Sequence
  Synthetic nucleic acid molecule
agcaccgtc

SEQ ID NO: 2518 - DNA, 9 bp, Artificial Sequence
  Synthetic nucleic acid molecule
agcaacgtc

SEQ ID NO: 2519 - DNA, 9 bp, Artificial Sequence
  Synthetic nucleic acid molecule
aacagcgtc

SEQ ID NO: 2520 - DNA, 9 bp, Artificial Sequence
  Synthetic nucleic acid molecule
agcaacgtc

SEQ ID NO: 2521 - DNA, 9 bp, Artificial Sequence
  Synthetic nucleic acid molecule
agcaacgtc

SEQ ID NO: 2522 - DNA, 9 bp, Artificial Sequence
  Synthetic nucleic acid molecule
agcaccgtc

SEQ ID NO: 2523 - DNA, 9 bp, Artificial Sequence
  Synthetic nucleic acid molecule
agcaccgtc

SEQ ID NO: 2524 - DNA, 9 bp, Artificial Sequence
  Synthetic nucleic acid molecule
agcagggtc

SEQ ID NO: 2525 - DNA, 9 bp, Artificial Sequence
  Synthetic nucleic acid molecule
agcaacgtc

SEQ ID NO: 2526 - DNA, 9 bp, Artificial Sequence
  Synthetic nucleic acid molecule
agcaacgtc

SEQ ID NO: 2527 - DNA, 9 bp, Artificial Sequence
  Synthetic nucleic acid molecule
agcagcttc

SEQ ID NO: 2528 - DNA, 9 bp, Artificial Sequence
  Synthetic nucleic acid molecule
ggcagcgtc

SEQ ID NO: 2529 - DNA, 9 bp, Artificial Sequence
  Synthetic nucleic acid molecule
agcaacgtc

SEQ ID NO: 2530 - DNA, 9 bp, Artificial Sequence
  Synthetic nucleic acid molecule
agcagcggc

SEQ ID NO: 2531 - DNA, 9 bp, Artificial Sequence
  Synthetic nucleic acid molecule
agcagcggc

SEQ ID NO: 2532 - DNA, 9 bp, Artificial Sequence
  Synthetic nucleic acid molecule
agcagtgtc

SEQ ID NO: 2533 - DNA, 9 bp, Artificial Sequence
  Synthetic nucleic acid molecule
agcagtgtc

SEQ ID NO: 2534 - DNA, 9 bp, Artificial Sequence
  Synthetic nucleic acid molecule
agcaacgtc

SEQ ID NO: 2535 - DNA, 9 bp, Artificial Sequence
  Synthetic nucleic acid molecule
agcaacgtc

SEQ ID NO: 2536 - DNA, 9 bp, Artificial Sequence
  Synthetic nucleic acid molecule
agcagtgtc

SEQ ID NO: 2537 - DNA, 9 bp, Artificial Sequence
  Synthetic nucleic acid molecule
agcaacgtc

SEQ ID NO: 2538 - DNA, 9 bp, Artificial Sequence
  Synthetic nucleic acid molecule
agcagcgtg

SEQ ID NO: 2539 - DNA, 9 bp, Artificial Sequence
  Synthetic nucleic acid molecule
agcagggtc

SEQ ID NO: 2540 - DNA, 9 bp, Artificial Sequence
  Synthetic nucleic acid molecule
agcaccgtc

SEQ ID NO: 2541 - DNA, 9 bp, Artificial Sequence
  Synthetic nucleic acid molecule
agcaccgtc

SEQ ID NO: 2542 - DNA, 9 bp, Artificial Sequence
  Synthetic nucleic acid molecule
atcagcgtc

SEQ ID NO: 2543 - DNA, 9 bp, Artificial Sequence
  Synthetic nucleic acid molecule
agcatcgtc

SEQ ID NO: 2544 - DNA, 9 bp, Artificial Sequence
  Synthetic nucleic acid molecule
agcaacgtc

SEQ ID NO: 2545 - DNA, 9 bp, Artificial Sequence
  Synthetic nucleic acid molecule
agcagcgac

SEQ ID NO: 2546 - DNA, 9 bp, Artificial Sequence
  Synthetic nucleic acid molecule
agcaccgtc

SEQ ID NO: 2547 - DNA, 9 bp, Artificial Sequence
  Synthetic nucleic acid molecule
agcagtgtc

SEQ ID NO: 2548 - DNA, 9 bp, Artificial Sequence
  Synthetic nucleic acid molecule
agcagtgtc

SEQ ID NO: 2549 - DNA, 9 bp, Artificial Sequence
  Synthetic nucleic acid molecule
agcagcggc

SEQ ID NO: 2550 - DNA, 9 bp, Artificial Sequence
  Synthetic nucleic acid molecule
agcagggtc

SEQ ID NO: 2551 - DNA, 9 bp, Artificial Sequence
  Synthetic nucleic acid molecule
agcaccggc

SEQ ID NO: 2552 - DNA, 9 bp, Artificial Sequence
  Synthetic nucleic acid molecule
agcagagtg

SEQ ID NO: 2553 - DNA, 9 bp, Artificial Sequence
  Synthetic nucleic acid molecule
agcaaggtc

SEQ ID NO: 2554 - DNA, 9 bp, Artificial Sequence
  Synthetic nucleic acid molecule
agcatggtc

SEQ ID NO: 2555 - DNA, 9 bp, Artificial Sequence
  Synthetic nucleic acid molecule
atcagtgtc

SEQ ID NO: 2556 - DNA, 9 bp, Artificial Sequence
  Synthetic nucleic acid molecule
agcatggtc

SEQ ID NO: 2557 - DNA, 9 bp, Artificial Sequence
  Synthetic nucleic acid molecule
agcaatgtc

SEQ ID NO: 2558 - DNA, 9 bp, Artificial Sequence
  Synthetic nucleic acid molecule
agcattgtc

SEQ ID NO: 2559 - DNA, 9 bp, Artificial Sequence
  Synthetic nucleic acid molecule
agcattgtc

SEQ ID NO: 2560 - DNA, 9 bp, Artificial Sequence
  Synthetic nucleic acid molecule
agcaaggtc

SEQ ID NO: 2561 - DNA, 9 bp, Artificial Sequence
  Synthetic nucleic acid molecule
agcagggta

SEQ ID NO: 2562 - DNA, 9 bp, Artificial Sequence
  Synthetic nucleic acid molecule
agcagcgca

SEQ ID NO: 2563 - DNA, 9 bp, Artificial Sequence
  Synthetic nucleic acid molecule
agcagcatt

SEQ ID NO: 2564 - DNA, 9 bp, Artificial Sequence
  Synthetic nucleic acid molecule
agcatggtc

SEQ ID NO: 2565 - DNA, 9 bp, Artificial Sequence
  Synthetic nucleic acid molecule
agctgcatc

SEQ ID NO: 2566 - DNA, 9 bp, Artificial Sequence
  Synthetic nucleic acid molecule
agaaacgtc

SEQ ID NO: 2567 - DNA, 9 bp, Artificial Sequence
  Synthetic nucleic acid molecule
tgcagtgtc

SEQ ID NO: 2568 - DNA, 9 bp, Artificial Sequence
  Synthetic nucleic acid molecule
aacaacgtc

SEQ ID NO: 2569 - DNA, 9 bp, Artificial Sequence
  Synthetic nucleic acid molecule
agcaaggtc

SEQ ID NO: 2570 - DNA, 9 bp, Artificial Sequence
  Synthetic nucleic acid molecule
agcagtgtg

SEQ ID NO: 2571 - DNA, 9 bp, Artificial Sequence
  Synthetic nucleic acid molecule
agtagtgtc

SEQ ID NO: 2572 - DNA, 9 bp, Artificial Sequence
  Synthetic nucleic acid molecule
agcagggtt

SEQ ID NO: 2573 - DNA, 9 bp, Artificial Sequence
  Synthetic nucleic acid molecule
agcatggtc

SEQ ID NO: 2574 - DNA, 9 bp, Artificial Sequence
  Synthetic nucleic acid molecule
agcagcatt

SEQ ID NO: 2575 - DNA, 9 bp, Artificial Sequence
  Synthetic nucleic acid molecule
agcaccgta

SEQ ID NO: 2576 - DNA, 9 bp, Artificial Sequence
  Synthetic nucleic acid molecule
agctgtgtc

SEQ ID NO: 2577 - DNA, 9 bp, Artificial Sequence
  Synthetic nucleic acid molecule
agccgggtc

SEQ ID NO: 2578 - DNA, 9 bp, Artificial Sequence
  Synthetic nucleic acid molecule
aacagggtc

SEQ ID NO: 2579 - DNA, 9 bp, Artificial Sequence
  Synthetic nucleic acid molecule
agcactgtc

SEQ ID NO: 2580 - DNA, 9 bp, Artificial Sequence
  Synthetic nucleic acid molecule
agcaacgtg

SEQ ID NO: 2581 - DNA, 9 bp, Artificial Sequence
  Synthetic nucleic acid molecule
agcagggtg

SEQ ID NO: 2582 - DNA, 9 bp, Artificial Sequence
  Synthetic nucleic acid molecule
agcacagtc

SEQ ID NO: 2583 - DNA, 9 bp, Artificial Sequence
  Synthetic nucleic acid molecule
agcattgtc

SEQ ID NO: 2584 - DNA, 9 bp, Artificial Sequence
  Synthetic nucleic acid molecule
atcagagtc

SEQ ID NO: 2585 - DNA, 9 bp, Artificial Sequence
  Synthetic nucleic acid molecule
agcaacctc

SEQ ID NO: 2586 - DNA, 9 bp, Artificial Sequence
  Synthetic nucleic acid molecule
agcggagtc

SEQ ID NO: 2587 - DNA, 9 bp, Artificial Sequence
  Synthetic nucleic acid molecule
agcatggtc

SEQ ID NO: 2588 - DNA, 9 bp, Artificial Sequence
  Synthetic nucleic acid molecule
tgcagtgtc

SEQ ID NO: 2589 - DNA, 9 bp, Artificial Sequence
  Synthetic nucleic acid molecule
ggcaccgtc

SEQ ID NO: 2590 - DNA, 9 bp, Artificial Sequence
  Synthetic nucleic acid molecule
agcaaagtc

SEQ ID NO: 2591 - DNA, 9 bp, Artificial Sequence
  Synthetic nucleic acid molecule
agcagcatt

SEQ ID NO: 2592 - DNA, 9 bp, Artificial Sequence
  Synthetic nucleic acid molecule
agcagcatt

SEQ ID NO: 2593 - DNA, 9 bp, Artificial Sequence
  Synthetic nucleic acid molecule
agcagtgac

SEQ ID NO: 2594 - DNA, 9 bp, Artificial Sequence
  Synthetic nucleic acid molecule
agcagtgac

SEQ ID NO: 2595 - DNA, 9 bp, Artificial Sequence
  Synthetic nucleic acid molecule
agcaatgtc

SEQ ID NO: 2596 - DNA, 9 bp, Artificial Sequence
  Synthetic nucleic acid molecule
agcaacatc

SEQ ID NO: 2597 - DNA, 9 bp, Artificial Sequence
  Synthetic nucleic acid molecule
tgcagggtc

SEQ ID NO: 2598 - DNA, 9 bp, Artificial Sequence
  Synthetic nucleic acid molecule
agcaacggc

SEQ ID NO: 2599 - DNA, 9 bp, Artificial Sequence
  Synthetic nucleic acid molecule
agcatggtc

SEQ ID NO: 2600 - DNA, 9 bp, Artificial Sequence
  Synthetic nucleic acid molecule
ggcagtgtc

SEQ ID NO: 2601 - DNA, 9 bp, Artificial Sequence
  Synthetic nucleic acid molecule
agcaccggc

SEQ ID NO: 2602 - DNA, 9 bp, Artificial Sequence
  Synthetic nucleic acid molecule
aacagtgtc

SEQ ID NO: 2603 - DNA, 9 bp, Artificial Sequence
  Synthetic nucleic acid molecule
agcaaagtc

SEQ ID NO: 2604 - DNA, 9 bp, Artificial Sequence
  Synthetic nucleic acid molecule
agcaatgtc

SEQ ID NO: 2605 - DNA, 9 bp, Artificial Sequence
  Synthetic nucleic acid molecule
agcagtctc

SEQ ID NO: 2606 - DNA, 9 bp, Artificial Sequence
  Synthetic nucleic acid molecule
agcaaagtc

SEQ ID NO: 2607 - DNA, 9 bp, Artificial Sequence
  Synthetic nucleic acid molecule
agcagcagc

SEQ ID NO: 2608 - DNA, 9 bp, Artificial Sequence
  Synthetic nucleic acid molecule
aacatcgtc

SEQ ID NO: 2609 - DNA, 9 bp, Artificial Sequence
  Synthetic nucleic acid molecule
agcaacatc

SEQ ID NO: 2610 - DNA, 9 bp, Artificial Sequence
  Synthetic nucleic acid molecule
agccccgtc

SEQ ID NO: 2611 - DNA, 9 bp, Artificial Sequence
  Synthetic nucleic acid molecule
agcagcggt

SEQ ID NO: 2612 - DNA, 9 bp, Artificial Sequence
  Synthetic nucleic acid molecule
agcaaggtc

SEQ ID NO: 2613 - DNA, 9 bp, Artificial Sequence
  Synthetic nucleic acid molecule
aacagagtc

SEQ ID NO: 2614 - DNA, 9 bp, Artificial Sequence
  Synthetic nucleic acid molecule
ggcagcgtg

SEQ ID NO: 2615 - DNA, 9 bp, Artificial Sequence
  Synthetic nucleic acid molecule
agcatagtc

SEQ ID NO: 2616 - DNA, 9 bp, Artificial Sequence
  Synthetic nucleic acid molecule
agccgtgtc

SEQ ID NO: 2617 - DNA, 9 bp, Artificial Sequence
  Synthetic nucleic acid molecule
agcatggtc

SEQ ID NO: 2618 - DNA, 9 bp, Artificial Sequence
  Synthetic nucleic acid molecule
agtagtgtc

SEQ ID NO: 2619 - DNA, 9 bp, Artificial Sequence
  Synthetic nucleic acid molecule
agcagcatt

SEQ ID NO: 2620 - DNA, 9 bp, Artificial Sequence
  Synthetic nucleic acid molecule
agcagcatt

SEQ ID NO: 2621 - DNA, 9 bp, Artificial Sequence
  Synthetic nucleic acid molecule
cgcagtgtc

SEQ ID NO: 2622 - DNA, 9 bp, Artificial Sequence
  Synthetic nucleic acid molecule
agcagggtg

SEQ ID NO: 2623 - DNA, 9 bp, Artificial Sequence
  Synthetic nucleic acid molecule
agcagggta

SEQ ID NO: 2624 - DNA, 9 bp, Artificial Sequence
  Synthetic nucleic acid molecule
agcatagtc

SEQ ID NO: 2625 - DNA, 9 bp, Artificial Sequence
  Synthetic nucleic acid molecule
agcatggtc

SEQ ID NO: 2626 - DNA, 9 bp, Artificial Sequence
  Synthetic nucleic acid molecule
tccagcgtc

SEQ ID NO: 2627 - DNA, 9 bp, Artificial Sequence
  Synthetic nucleic acid molecule
agcactgtc

SEQ ID NO: 2628 - DNA, 9 bp, Artificial Sequence
  Synthetic nucleic acid molecule
agcatagtc

SEQ ID NO: 2629 - DNA, 9 bp, Artificial Sequence
  Synthetic nucleic acid molecule
agcagtgtg

SEQ ID NO: 2630 - DNA, 9 bp, Artificial Sequence
  Synthetic nucleic acid molecule
agcaacggc

SEQ ID NO: 2631 - DNA, 9 bp, Artificial Sequence
  Synthetic nucleic acid molecule
agccgggtc

SEQ ID NO: 2632 - DNA, 9 bp, Artificial Sequence
  Synthetic nucleic acid molecule
agcaatgtc

SEQ ID NO: 2633 - DNA, 9 bp, Artificial Sequence
  Synthetic nucleic acid molecule
agcaacgtg

SEQ ID NO: 2634 - DNA, 9 bp, Artificial Sequence
  Synthetic nucleic acid molecule
agcacggtc

SEQ ID NO: 2635 - DNA, 9 bp, Artificial Sequence
  Synthetic nucleic acid molecule
agcatggtc

SEQ ID NO: 2636 - DNA, 9 bp, Artificial Sequence
  Synthetic nucleic acid molecule
agcagggta

SEQ ID NO: 2637 - DNA, 9 bp, Artificial Sequence
  Synthetic nucleic acid molecule
agcggtgtc

SEQ ID NO: 2638 - DNA, 9 bp, Artificial Sequence
  Synthetic nucleic acid molecule
agcaaggtc

SEQ ID NO: 2639 - DNA, 9 bp, Artificial Sequence
  Synthetic nucleic acid molecule
agcaccttc

SEQ ID NO: 2640 - DNA, 9 bp, Artificial Sequence
  Synthetic nucleic acid molecule
agcaaagtc

SEQ ID NO: 2641 - DNA, 9 bp, Artificial Sequence
  Synthetic nucleic acid molecule
agcaaggtc

SEQ ID NO: 2642 - DNA, 9 bp, Artificial Sequence
  Synthetic nucleic acid molecule
agcagcagc

SEQ ID NO: 2643 - DNA, 9 bp, Artificial Sequence
  Synthetic nucleic acid molecule
agcaacctc

SEQ ID NO: 2644 - DNA, 9 bp, Artificial Sequence
  Synthetic nucleic acid molecule
tgcagcgac

SEQ ID NO: 2645 - DNA, 9 bp, Artificial Sequence
  Synthetic nucleic acid molecule
ggcagcttc

SEQ ID NO: 2646 - DNA, 9 bp, Artificial Sequence
  Synthetic nucleic acid molecule
aacagtgtc

SEQ ID NO: 2647 - DNA, 9 bp, Artificial Sequence
  Synthetic nucleic acid molecule
agcttcgtc

SEQ ID NO: 2648 - DNA, 9 bp, Artificial Sequence
  Synthetic nucleic acid molecule
agcagcatt

SEQ ID NO: 2649 - DNA, 9 bp, Artificial Sequence
  Synthetic nucleic acid molecule
agcaacgtg

SEQ ID NO: 2650 - DNA, 9 bp, Artificial Sequence
  Synthetic nucleic acid molecule
agcaatgtc

SEQ ID NO: 2651 - DNA, 9 bp, Artificial Sequence
  Synthetic nucleic acid molecule
tgcagtgtc

SEQ ID NO: 2652 - DNA, 9 bp, Artificial Sequence
  Synthetic nucleic acid molecule
agcaacggc

SEQ ID NO: 2653 - DNA, 9 bp, Artificial Sequence
  Synthetic nucleic acid molecule
agcatcggc

SEQ ID NO: 2654 - DNA, 9 bp, Artificial Sequence
  Synthetic nucleic acid molecule
agcatcggc

SEQ ID NO: 2655 - DNA, 9 bp, Artificial Sequence
  Synthetic nucleic acid molecule
agcatcggc

SEQ ID NO: 2656 - DNA, 9 bp, Artificial Sequence
  Synthetic nucleic acid molecule
agcaaggtc

SEQ ID NO: 2657 - DNA, 9 bp, Artificial Sequence
  Synthetic nucleic acid molecule
agcggagtc

SEQ ID NO: 2658 - DNA, 9 bp, Artificial Sequence
  Synthetic nucleic acid molecule
agcaccatc

SEQ ID NO: 2659 - DNA, 9 bp, Artificial Sequence
  Synthetic nucleic acid molecule
agctgcttc

SEQ ID NO: 2660 - DNA, 9 bp, Artificial Sequence
  Synthetic nucleic acid molecule
agcaacatc

SEQ ID NO: 2661 - DNA, 9 bp, Artificial Sequence
  Synthetic nucleic acid molecule
aacagtgtc

SEQ ID NO: 2662 - DNA, 9 bp, Artificial Sequence
  Synthetic nucleic acid molecule
agcatcgta

SEQ ID NO: 2663 - DNA, 9 bp, Artificial Sequence
  Synthetic nucleic acid molecule
agcatggtc

SEQ ID NO: 2664 - DNA, 9 bp, Artificial Sequence
  Synthetic nucleic acid molecule
aacagcttc

SEQ ID NO: 2665 - DNA, 9 bp, Artificial Sequence
  Synthetic nucleic acid molecule
agcaacttc

SEQ ID NO: 2666 - DNA, 9 bp, Artificial Sequence
  Synthetic nucleic acid molecule
agcagcatt

SEQ ID NO: 2667 - DNA, 9 bp, Artificial Sequence
  Synthetic nucleic acid molecule
agcagggtg

SEQ ID NO: 2668 - DNA, 9 bp, Artificial Sequence
  Synthetic nucleic acid molecule
agcattgtc

SEQ ID NO: 2669 - DNA, 9 bp, Artificial Sequence
  Synthetic nucleic acid molecule
ggcagcgtg

SEQ ID NO: 2670 - DNA, 9 bp, Artificial Sequence
  Synthetic nucleic acid molecule
agctgtgtc

SEQ ID NO: 2671 - DNA, 9 bp, Artificial Sequence
  Synthetic nucleic acid molecule
agcagcatt

SEQ ID NO: 2672 - DNA, 9 bp, Artificial Sequence
  Synthetic nucleic acid molecule
agcagtgtt

SEQ ID NO: 2673 - DNA, 9 bp, Artificial Sequence
  Synthetic nucleic acid molecule
agcacagtc

SEQ ID NO: 2674 - DNA, 9 bp, Artificial Sequence
  Synthetic nucleic acid molecule
ggcagcttc

SEQ ID NO: 2675 - DNA, 9 bp, Artificial Sequence
  Synthetic nucleic acid molecule
agcattgtc

SEQ ID NO: 2676 - DNA, 9 bp, Artificial Sequence
  Synthetic nucleic acid molecule
agcatggtc

SEQ ID NO: 2677 - DNA, 9 bp, Artificial Sequence
  Synthetic nucleic acid molecule
agcagggtg

SEQ ID NO: 2678 - DNA, 9 bp, Artificial Sequence
  Synthetic nucleic acid molecule
agcaacttc

SEQ ID NO: 2679 - DNA, 9 bp, Artificial Sequence
  Synthetic nucleic acid molecule
agcagcagc

SEQ ID NO: 2680 - DNA, 9 bp, Artificial Sequence
  Synthetic nucleic acid molecule
tgcagggtc

SEQ ID NO: 2681 - DNA, 9 bp, Artificial Sequence
  Synthetic nucleic acid molecule
tgcagcgtt

SEQ ID NO: 2682 - DNA, 9 bp, Artificial Sequence
  Synthetic nucleic acid molecule
agcagcata

SEQ ID NO: 2683 - DNA, 9 bp, Artificial Sequence
  Synthetic nucleic acid molecule
agcagtgtg

SEQ ID NO: 2684 - DNA, 9 bp, Artificial Sequence
  Synthetic nucleic acid molecule
aacagcatc

SEQ ID NO: 2685 - DNA, 9 bp, Artificial Sequence
  Synthetic nucleic acid molecule
agcagtgtg

SEQ ID NO: 2686 - DNA, 9 bp, Artificial Sequence
  Synthetic nucleic acid molecule
aacagagtc

SEQ ID NO: 2687 - DNA, 9 bp, Artificial Sequence
  Synthetic nucleic acid molecule
agcaacgtt

SEQ ID NO: 2688 - DNA, 9 bp, Artificial Sequence
  Synthetic nucleic acid molecule
agcaaagtc

SEQ ID NO: 2689 - DNA, 9 bp, Artificial Sequence
  Synthetic nucleic acid molecule
tgcatcgtc

SEQ ID NO: 2690 - DNA, 9 bp, Artificial Sequence
  Synthetic nucleic acid molecule
agcaaggtc

SEQ ID NO: 2691 - DNA, 9 bp, Artificial Sequence
  Synthetic nucleic acid molecule
ggcaccgtc

SEQ ID NO: 2692 - DNA, 9 bp, Artificial Sequence
  Synthetic nucleic acid molecule
agcagagta

SEQ ID NO: 2693 - DNA, 9 bp, Artificial Sequence
  Synthetic nucleic acid molecule
agcaaagtc

SEQ ID NO: 2694 - DNA, 9 bp, Artificial Sequence
  Synthetic nucleic acid molecule
agaagtgtc

SEQ ID NO: 2695 - DNA, 9 bp, Artificial Sequence
  Synthetic nucleic acid molecule
agcagcatt

SEQ ID NO: 2696 - DNA, 9 bp, Artificial Sequence
  Synthetic nucleic acid molecule
agcaaagtc

SEQ ID NO: 2697 - DNA, 9 bp, Artificial Sequence
  Synthetic nucleic acid molecule
agcaaagtc

SEQ ID NO: 2698 - DNA, 9 bp, Artificial Sequence
  Synthetic nucleic acid molecule
ggcagtgtc

SEQ ID NO: 2699 - DNA, 9 bp, Artificial Sequence
  Synthetic nucleic acid molecule
agcagcaac

SEQ ID NO: 2700 - DNA, 9 bp, Artificial Sequence
  Synthetic nucleic acid molecule
agcattgtc

SEQ ID NO: 2701 - DNA, 9 bp, Artificial Sequence
  Synthetic nucleic acid molecule
agcaaggtc

SEQ ID NO: 2702 - DNA, 9 bp, Artificial Sequence
  Synthetic nucleic acid molecule
agcatcggc

SEQ ID NO: 2703 - DNA, 9 bp, Artificial Sequence
  Synthetic nucleic acid molecule
agcagggtg

SEQ ID NO: 2704 - DNA, 9 bp, Artificial Sequence
  Synthetic nucleic acid molecule
agcagcgct

SEQ ID NO: 2705 - DNA, 9 bp, Artificial Sequence
  Synthetic nucleic acid molecule
agcagggtg

SEQ ID NO: 2706 - DNA, 9 bp, Artificial Sequence
  Synthetic nucleic acid molecule
tgcagcgtg

SEQ ID NO: 2707 - DNA, 9 bp, Artificial Sequence
  Synthetic nucleic acid molecule
tgcagtgtc

SEQ ID NO: 2708 - DNA, 9 bp, Artificial Sequence
  Synthetic nucleic acid molecule
agcagggtg

SEQ ID NO: 2709 - DNA, 9 bp, Artificial Sequence
  Synthetic nucleic acid molecule
aacagggtc

SEQ ID NO: 2710 - DNA, 9 bp, Artificial Sequence
  Synthetic nucleic acid molecule
aacagcggc

SEQ ID NO: 2711 - DNA, 9 bp, Artificial Sequence
  Synthetic nucleic acid molecule
agcaacgtt

SEQ ID NO: 2712 - DNA, 9 bp, Artificial Sequence
  Synthetic nucleic acid molecule
agcagtgtt

SEQ ID NO: 2713 - DNA, 9 bp, Artificial Sequence
  Synthetic nucleic acid molecule
agcaccgtg

SEQ ID NO: 2714 - DNA, 9 bp, Artificial Sequence
  Synthetic nucleic acid molecule
agcaacgtt

SEQ ID NO: 2715 - DNA, 9 bp, Artificial Sequence
  Synthetic nucleic acid molecule
agccacgtc

SEQ ID NO: 2716 - DNA, 9 bp, Artificial Sequence
  Synthetic nucleic acid molecule
agcagggtg

SEQ ID NO: 2717 - DNA, 9 bp, Artificial Sequence
  Synthetic nucleic acid molecule
tgcagcggc

SEQ ID NO: 2718 - DNA, 9 bp, Artificial Sequence
  Synthetic nucleic acid molecule
agcattgtc

SEQ ID NO: 2719 - DNA, 9 bp, Artificial Sequence
  Synthetic nucleic acid molecule
ggcaccgtc

SEQ ID NO: 2720 - DNA, 9 bp, Artificial Sequence
  Synthetic nucleic acid molecule
agcatggtc

SEQ ID NO: 2721 - DNA, 9 bp, Artificial Sequence
  Synthetic nucleic acid molecule
agcaccttc

SEQ ID NO: 2722 - DNA, 9 bp, Artificial Sequence
  Synthetic nucleic acid molecule
agtagtgtc

SEQ ID NO: 2723 - DNA, 9 bp, Artificial Sequence
  Synthetic nucleic acid molecule
agcaccatc

SEQ ID NO: 2724 - DNA, 9 bp, Artificial Sequence
  Synthetic nucleic acid molecule
agccacgtc

SEQ ID NO: 2725 - DNA, 9 bp, Artificial Sequence
  Synthetic nucleic acid molecule
agcaacatc

SEQ ID NO: 2726 - DNA, 9 bp, Artificial Sequence
  Synthetic nucleic acid molecule
agccgagtc

SEQ ID NO: 2727 - DNA, 9 bp, Artificial Sequence
  Synthetic nucleic acid molecule
accagtgtc

SEQ ID NO: 2728 - DNA, 9 bp, Artificial Sequence
  Synthetic nucleic acid molecule
agcaacgac

SEQ ID NO: 2729 - DNA, 9 bp, Artificial Sequence
  Synthetic nucleic acid molecule
agcagcatt

SEQ ID NO: 2730 - DNA, 9 bp, Artificial Sequence
  Synthetic nucleic acid molecule
agcagcatt

SEQ ID NO: 2731 - DNA, 9 bp, Artificial Sequence
  Synthetic nucleic acid molecule
cgcagtgtc

SEQ ID NO: 2732 - DNA, 9 bp, Artificial Sequence
  Synthetic nucleic acid molecule
tgcatcgtc

SEQ ID NO: 2733 - DNA, 9 bp, Artificial Sequence
  Synthetic nucleic acid molecule
agctgagtc

SEQ ID NO: 2734 - DNA, 9 bp, Artificial Sequence
  Synthetic nucleic acid molecule
agcaacgtg

SEQ ID NO: 2735 - DNA, 9 bp, Artificial Sequence
  Synthetic nucleic acid molecule
agcagtggc

SEQ ID NO: 2736 - DNA, 9 bp, Artificial Sequence
  Synthetic nucleic acid molecule
agcagcatt

SEQ ID NO: 2737 - DNA, 9 bp, Artificial Sequence
  Synthetic nucleic acid molecule
agcaccatc

SEQ ID NO: 2738 - DNA, 9 bp, Artificial Sequence
  Synthetic nucleic acid molecule
agcacagtc

SEQ ID NO: 2739 - DNA, 9 bp, Artificial Sequence
  Synthetic nucleic acid molecule
agcatggtc

SEQ ID NO: 2740 - DNA, 9 bp, Artificial Sequence
  Synthetic nucleic acid molecule
agcatggtc

SEQ ID NO: 2741 - DNA, 9 bp, Artificial Sequence
  Synthetic nucleic acid molecule
agtaacgtc

SEQ ID NO: 2742 - DNA, 9 bp, Artificial Sequence
  Synthetic nucleic acid molecule
agcaacttc

SEQ ID NO: 2743 - DNA, 9 bp, Artificial Sequence
  Synthetic nucleic acid molecule
agcagcatt

SEQ ID NO: 2744 - DNA, 9 bp, Artificial Sequence
  Synthetic nucleic acid molecule
agcaatgtc

SEQ ID NO: 2745 - DNA, 9 bp, Artificial Sequence
  Synthetic nucleic acid molecule
agcaatgtc

SEQ ID NO: 2746 - DNA, 9 bp, Artificial Sequence
  Synthetic nucleic acid molecule
agcagattc

SEQ ID NO: 2747 - DNA, 9 bp, Artificial Sequence
  Synthetic nucleic acid molecule
cacagcgtc

SEQ ID NO: 2748 - DNA, 9 bp, Artificial Sequence
  Synthetic nucleic acid molecule
agcagcgat

SEQ ID NO: 2749 - DNA, 9 bp, Artificial Sequence
  Synthetic nucleic acid molecule
agcaccgtg

SEQ ID NO: 2750 - DNA, 9 bp, Artificial Sequence
  Synthetic nucleic acid molecule
atcagtgtc

SEQ ID NO: 2751 - DNA, 9 bp, Artificial Sequence
  Synthetic nucleic acid molecule
agcaacctc

SEQ ID NO: 2752 - DNA, 9 bp, Artificial Sequence
  Synthetic nucleic acid molecule
agcaacttc

SEQ ID NO: 2753 - DNA, 9 bp, Artificial Sequence
  Synthetic nucleic acid molecule
agcaacttc

SEQ ID NO: 2754 - DNA, 9 bp, Artificial Sequence
  Synthetic nucleic acid molecule
agcaacgtg

SEQ ID NO: 2755 - DNA, 9 bp, Artificial Sequence
  Synthetic nucleic acid molecule
aacagcatc

SEQ ID NO: 2756 - DNA, 9 bp, Artificial Sequence
  Synthetic nucleic acid molecule
acaagcgtc

SEQ ID NO: 2757 - DNA, 9 bp, Artificial Sequence
  Synthetic nucleic acid molecule
tccagcgtc

SEQ ID NO: 2758 - DNA, 9 bp, Artificial Sequence
  Synthetic nucleic acid molecule
agcaaggtc

SEQ ID NO: 2759 - DNA, 9 bp, Artificial Sequence
  Synthetic nucleic acid molecule
agtagcgtt

SEQ ID NO: 2760 - DNA, 9 bp, Artificial Sequence
  Synthetic nucleic acid molecule
agcagtgtt

SEQ ID NO: 2761 - DNA, 9 bp, Artificial Sequence
  Synthetic nucleic acid molecule
agcatggtc

SEQ ID NO: 2762 - DNA, 9 bp, Artificial Sequence
  Synthetic nucleic acid molecule
agcagcgga

SEQ ID NO: 2763 - DNA, 9 bp, Artificial Sequence
  Synthetic nucleic acid molecule
agcaccgac

SEQ ID NO: 2764 - DNA, 9 bp, Artificial Sequence
  Synthetic nucleic acid molecule
agcagtgac

SEQ ID NO: 2765 - DNA, 9 bp, Artificial Sequence
  Synthetic nucleic acid molecule
agcagggtt

SEQ ID NO: 2766 - DNA, 9 bp, Artificial Sequence
  Synthetic nucleic acid molecule
agcagcatg

SEQ ID NO: 2767 - DNA, 9 bp, Artificial Sequence
  Synthetic nucleic acid molecule
atcagagtc

SEQ ID NO: 2768 - DNA, 9 bp, Artificial Sequence
  Synthetic nucleic acid molecule
agcagggtt

SEQ ID NO: 2769 - DNA, 9 bp, Artificial Sequence
  Synthetic nucleic acid molecule
agcagggtg

SEQ ID NO: 2770 - DNA, 9 bp, Artificial Sequence
  Synthetic nucleic acid molecule
ggcagtgtc

SEQ ID NO: 2771 - DNA, 9 bp, Artificial Sequence
  Synthetic nucleic acid molecule
ggcatcgtc

SEQ ID NO: 2772 - DNA, 9 bp, Artificial Sequence
  Synthetic nucleic acid molecule
agcaccgtg

SEQ ID NO: 2773 - DNA, 9 bp, Artificial Sequence
  Synthetic nucleic acid molecule
agcagagtt

SEQ ID NO: 2774 - DNA, 9 bp, Artificial Sequence
  Synthetic nucleic acid molecule
gacagcctc

SEQ ID NO: 2775 - DNA, 9 bp, Artificial Sequence
  Synthetic nucleic acid molecule
aggggggtc

SEQ ID NO: 2776 - DNA, 9 bp, Artificial Sequence
  Synthetic nucleic acid molecule
agcctggtc

SEQ ID NO: 2777 - DNA, 9 bp, Artificial Sequence
  Synthetic nucleic acid molecule
ggcagcgat

SEQ ID NO: 2778 - DNA, 9 bp, Artificial Sequence
  Synthetic nucleic acid molecule
aacaaggtc

SEQ ID NO: 2779 - DNA, 9 bp, Artificial Sequence
  Synthetic nucleic acid molecule
agctgagac

SEQ ID NO: 2780 - DNA, 9 bp, Artificial Sequence
  Synthetic nucleic acid molecule
agctgagac

SEQ ID NO: 2781 - DNA, 9 bp, Artificial Sequence
  Synthetic nucleic acid molecule
ggcagagtg

SEQ ID NO: 2782 - DNA, 9 bp, Artificial Sequence
  Synthetic nucleic acid molecule
agctgggtt

SEQ ID NO: 2783 - DNA, 9 bp, Artificial Sequence
  Synthetic nucleic acid molecule
agcaaaggc

SEQ ID NO: 2784 - DNA, 9 bp, Artificial Sequence
  Synthetic nucleic acid molecule
agtaacggc

SEQ ID NO: 2785 - DNA, 9 bp, Artificial Sequence
  Synthetic nucleic acid molecule
agcattgtt

SEQ ID NO: 2786 - DNA, 9 bp, Artificial Sequence
  Synthetic nucleic acid molecule
cacagcatc

SEQ ID NO: 2787 - DNA, 9 bp, Artificial Sequence
  Synthetic nucleic acid molecule
agccacatc

SEQ ID NO: 2788 - DNA, 9 bp, Artificial Sequence
  Synthetic nucleic acid molecule
agcagcaca

SEQ ID NO: 2789 - DNA, 9 bp, Artificial Sequence
  Synthetic nucleic acid molecule
agcattgcc

SEQ ID NO: 2790 - DNA, 9 bp, Artificial Sequence
  Synthetic nucleic acid molecule
agaagtgcc

SEQ ID NO: 2791 - DNA, 9 bp, Artificial Sequence
  Synthetic nucleic acid molecule
atcagcata

SEQ ID NO: 2792 - DNA, 9 bp, Artificial Sequence
  Synthetic nucleic acid molecule
agcaggtac

SEQ ID NO: 2793 - DNA, 9 bp, Artificial Sequence
  Synthetic nucleic acid molecule
aactacgtc

SEQ ID NO: 2794 - DNA, 9 bp, Artificial Sequence
  Synthetic nucleic acid molecule
agaagtgcc

SEQ ID NO: 2795 - DNA, 9 bp, Artificial Sequence
  Synthetic nucleic acid molecule
aggagtctc

SEQ ID NO: 2796 - DNA, 9 bp, Artificial Sequence
  Synthetic nucleic acid molecule
tccagcggc

SEQ ID NO: 2797 - DNA, 9 bp, Artificial Sequence
  Synthetic nucleic acid molecule
agctcagtc

SEQ ID NO: 2798 - DNA, 9 bp, Artificial Sequence
  Synthetic nucleic acid molecule
agctcagtc

SEQ ID NO: 2799 - DNA, 9 bp, Artificial Sequence
  Synthetic nucleic acid molecule
aacagtatc

SEQ ID NO: 2800 - DNA, 9 bp, Artificial Sequence
  Synthetic nucleic acid molecule
ggaagtgtc

SEQ ID NO: 2801 - DNA, 9 bp, Artificial Sequence
  Synthetic nucleic acid molecule
ctcagagtc

SEQ ID NO: 2802 - DNA, 9 bp, Artificial Sequence
  Synthetic nucleic acid molecule
aacagtgtt

SEQ ID NO: 2803 - DNA, 9 bp, Artificial Sequence
  Synthetic nucleic acid molecule
ctcagcttc

SEQ ID NO: 2804 - DNA, 9 bp, Artificial Sequence
  Synthetic nucleic acid molecule
agcagctgt

SEQ ID NO: 2805 - DNA, 9 bp, Artificial Sequence
  Synthetic nucleic acid molecule
agctgtgtg

SEQ ID NO: 2806 - DNA, 9 bp, Artificial Sequence
  Synthetic nucleic acid molecule
aggtgtgtc

SEQ ID NO: 2807 - DNA, 9 bp, Artificial Sequence
  Synthetic nucleic acid molecule
attagagtc

SEQ ID NO: 2808 - DNA, 9 bp, Artificial Sequence
  Synthetic nucleic acid molecule
agccggctc

SEQ ID NO: 2809 - DNA, 9 bp, Artificial Sequence
  Synthetic nucleic acid molecule
agcaccagc

SEQ ID NO: 2810 - DNA, 9 bp, Artificial Sequence
  Synthetic nucleic acid molecule
ttcagcgtt

SEQ ID NO: 2811 - DNA, 9 bp, Artificial Sequence
  Synthetic nucleic acid molecule
agctccttc

SEQ ID NO: 2812 - DNA, 9 bp, Artificial Sequence
  Synthetic nucleic acid molecule
aagagtgtc

SEQ ID NO: 2813 - DNA, 9 bp, Artificial Sequence
  Synthetic nucleic acid molecule
tgcagggta

SEQ ID NO: 2814 - DNA, 9 bp, Artificial Sequence
  Synthetic nucleic acid molecule
aggatcatc

SEQ ID NO: 2815 - DNA, 9 bp, Artificial Sequence
  Synthetic nucleic acid molecule
gtctgcgtc

SEQ ID NO: 2816 - DNA, 9 bp, Artificial Sequence
  Synthetic nucleic acid molecule
atgagcgac

SEQ ID NO: 2817 - DNA, 9 bp, Artificial Sequence
  Synthetic nucleic acid molecule
cccagggtc

SEQ ID NO: 2818 - DNA, 9 bp, Artificial Sequence
  Synthetic nucleic acid molecule
agtacagtc

SEQ ID NO: 2819 - DNA, 9 bp, Artificial Sequence
  Synthetic nucleic acid molecule
agcttcctc

SEQ ID NO: 2820 - DNA, 9 bp, Artificial Sequence
  Synthetic nucleic acid molecule
agaagtgcc

SEQ ID NO: 2821 - DNA, 9 bp, Artificial Sequence
  Synthetic nucleic acid molecule
ggcagagtg

SEQ ID NO: 2822 - DNA, 9 bp, Artificial Sequence
  Synthetic nucleic acid molecule
agcagttcc

SEQ ID NO: 2823 - DNA, 9 bp, Artificial Sequence
  Synthetic nucleic acid molecule
ggcactgtc

SEQ ID NO: 2824 - DNA, 9 bp, Artificial Sequence
  Synthetic nucleic acid molecule
agcaggcac

SEQ ID NO: 2825 - DNA, 9 bp, Artificial Sequence
  Synthetic nucleic acid molecule
agtggagtc

SEQ ID NO: 2826 - DNA, 9 bp, Artificial Sequence
  Synthetic nucleic acid molecule
aggacagtc

SEQ ID NO: 2827 - DNA, 9 bp, Artificial Sequence
  Synthetic nucleic acid molecule
agctgtgtg

SEQ ID NO: 2828 - DNA, 9 bp, Artificial Sequence
  Synthetic nucleic acid molecule
agcaaggtg

SEQ ID NO: 2829 - DNA, 9 bp, Artificial Sequence
  Synthetic nucleic acid molecule
tgctgtgtc

SEQ ID NO: 2830 - DNA, 9 bp, Artificial Sequence
  Synthetic nucleic acid molecule
ggcacagtc

SEQ ID NO: 2831 - DNA, 9 bp, Artificial Sequence
  Synthetic nucleic acid molecule
agctcagtc

SEQ ID NO: 2832 - DNA, 9 bp, Artificial Sequence
  Synthetic nucleic acid molecule
gtcagtgtc

SEQ ID NO: 2833 - DNA, 9 bp, Artificial Sequence
  Synthetic nucleic acid molecule
ggaagggtc

SEQ ID NO: 2834 - DNA, 9 bp, Artificial Sequence
  Synthetic nucleic acid molecule
aggagcaac

SEQ ID NO: 2835 - DNA, 9 bp, Artificial Sequence
  Synthetic nucleic acid molecule
agcggtttc

SEQ ID NO: 2836 - DNA, 9 bp, Artificial Sequence
  Synthetic nucleic acid molecule
agcagcacg

SEQ ID NO: 2837 - DNA, 9 bp, Artificial Sequence
  Synthetic nucleic acid molecule
agaagggtg

SEQ ID NO: 2838 - DNA, 9 bp, Artificial Sequence
  Synthetic nucleic acid molecule
tgctgtgtc

SEQ ID NO: 2839 - DNA, 9 bp, Artificial Sequence
  Synthetic nucleic acid molecule
agctcagtc

SEQ ID NO: 2840 - DNA, 9 bp, Artificial Sequence
  Synthetic nucleic acid molecule
agcaaggtt

SEQ ID NO: 2841 - DNA, 9 bp, Artificial Sequence
  Synthetic nucleic acid molecule
agctcagtc

SEQ ID NO: 2842 - DNA, 9 bp, Artificial Sequence
  Synthetic nucleic acid molecule
agcacggtg

SEQ ID NO: 2843 - DNA, 9 bp, Artificial Sequence
  Synthetic nucleic acid molecule
agcagggat

SEQ ID NO: 2844 - DNA, 9 bp, Artificial Sequence
  Synthetic nucleic acid molecule
atcagcttt

SEQ ID NO: 2845 - DNA, 9 bp, Artificial Sequence
  Synthetic nucleic acid molecule
agcacagac

SEQ ID NO: 2846 - DNA, 9 bp, Artificial Sequence
  Synthetic nucleic acid molecule
cccagcttc

SEQ ID NO: 2847 - DNA, 9 bp, Artificial Sequence
  Synthetic nucleic acid molecule
cgccccgtc

SEQ ID NO: 2848 - DNA, 9 bp, Artificial Sequence
  Synthetic nucleic acid molecule
agcagaggt

SEQ ID NO: 2849 - DNA, 9 bp, Artificial Sequence
  Synthetic nucleic acid molecule
agccacctc

SEQ ID NO: 2850 - DNA, 9 bp, Artificial Sequence
  Synthetic nucleic acid molecule
agccctgtc

SEQ ID NO: 2851 - DNA, 9 bp, Artificial Sequence
  Synthetic nucleic acid molecule
agcagcagt

SEQ ID NO: 2852 - DNA, 9 bp, Artificial Sequence
  Synthetic nucleic acid molecule
agccacttc

SEQ ID NO: 2853 - DNA, 9 bp, Artificial Sequence
  Synthetic nucleic acid molecule
aggtgcggc

SEQ ID NO: 2854 - DNA, 9 bp, Artificial Sequence
  Synthetic nucleic acid molecule
agctgtgtg

SEQ ID NO: 2855 - DNA, 9 bp, Artificial Sequence
  Synthetic nucleic acid molecule
aggcgcttc

SEQ ID NO: 2856 - DNA, 9 bp, Artificial Sequence
  Synthetic nucleic acid molecule
aggagtctc

SEQ ID NO: 2857 - DNA, 9 bp, Artificial Sequence
  Synthetic nucleic acid molecule
atcatcctc

SEQ ID NO: 2858 - DNA, 9 bp, Artificial Sequence
  Synthetic nucleic acid molecule
agccgggta

SEQ ID NO: 2859 - DNA, 9 bp, Artificial Sequence
  Synthetic nucleic acid molecule
agcaactgc

SEQ ID NO: 2860 - DNA, 9 bp, Artificial Sequence
  Synthetic nucleic acid molecule
ggcagcatt

SEQ ID NO: 2861 - DNA, 9 bp, Artificial Sequence
  Synthetic nucleic acid molecule
cacagcatc

SEQ ID NO: 2862 - DNA, 9 bp, Artificial Sequence
  Synthetic nucleic acid molecule
agctgagac

SEQ ID NO: 2863 - DNA, 9 bp, Artificial Sequence
  Synthetic nucleic acid molecule
acccgtgtc

SEQ ID NO: 2864 - DNA, 9 bp, Artificial Sequence
  Synthetic nucleic acid molecule
agccctgtc

SEQ ID NO: 2865 - DNA, 9 bp, Artificial Sequence
  Synthetic nucleic acid molecule
ggacgcgtc

SEQ ID NO: 2866 - DNA, 9 bp, Artificial Sequence
  Synthetic nucleic acid molecule
aggaacctc

SEQ ID NO: 2867 - DNA, 9 bp, Artificial Sequence
  Synthetic nucleic acid molecule
agctgtgtg

SEQ ID NO: 2868 - DNA, 9 bp, Artificial Sequence
  Synthetic nucleic acid molecule
cgctgcgac

SEQ ID NO: 2869 - DNA, 9 bp, Artificial Sequence
  Synthetic nucleic acid molecule
ggtagagtc

SEQ ID NO: 2870 - DNA, 9 bp, Artificial Sequence
  Synthetic nucleic acid molecule
agctgagac

SEQ ID NO: 2871 - DNA, 9 bp, Artificial Sequence
  Synthetic nucleic acid molecule
accaacctc

SEQ ID NO: 2872 - DNA, 9 bp, Artificial Sequence
  Synthetic nucleic acid molecule
agcagtctg

SEQ ID NO: 2873 - DNA, 9 bp, Artificial Sequence
  Synthetic nucleic acid molecule
tgctgtgtc

SEQ ID NO: 2874 - DNA, 9 bp, Artificial Sequence
  Synthetic nucleic acid molecule
agaaacttc

SEQ ID NO: 2875 - DNA, 9 bp, Artificial Sequence
  Synthetic nucleic acid molecule
aacaatgtc

SEQ ID NO: 2876 - DNA, 9 bp, Artificial Sequence
  Synthetic nucleic acid molecule
agaagggtg

SEQ ID NO: 2877 - DNA, 9 bp, Artificial Sequence
  Synthetic nucleic acid molecule
tgcagcgga

SEQ ID NO: 2878 - DNA, 9 bp, Artificial Sequence
  Synthetic nucleic acid molecule
agctgtgtg

SEQ ID NO: 2879 - DNA, 9 bp, Artificial Sequence
  Synthetic nucleic acid molecule
aatagagtc

SEQ ID NO: 2880 - DNA, 9 bp, Artificial Sequence
  Synthetic nucleic acid molecule
agctgagac

SEQ ID NO: 2881 - DNA, 9 bp, Artificial Sequence
  Synthetic nucleic acid molecule
agctgagac

SEQ ID NO: 2882 - DNA, 9 bp, Artificial Sequence
  Synthetic nucleic acid molecule
agtagcatt

SEQ ID NO: 2883 - DNA, 9 bp, Artificial Sequence
  Synthetic nucleic acid molecule
accggagtc

SEQ ID NO: 2884 - DNA, 9 bp, Artificial Sequence
  Synthetic nucleic acid molecule
agcagtctg

SEQ ID NO: 2885 - DNA, 9 bp, Artificial Sequence
  Synthetic nucleic acid molecule
agcagcaca

SEQ ID NO: 2886 - DNA, 9 bp, Artificial Sequence
  Synthetic nucleic acid molecule
agcagccat

SEQ ID NO: 2887 - DNA, 9 bp, Artificial Sequence
  Synthetic nucleic acid molecule
gccagggtc

SEQ ID NO: 2888 - DNA, 9 bp, Artificial Sequence
  Synthetic nucleic acid molecule
agcatctta

SEQ ID NO: 2889 - DNA, 9 bp, Artificial Sequence
  Synthetic nucleic acid molecule
aggagcaac

SEQ ID NO: 2890 - DNA, 9 bp, Artificial Sequence
  Synthetic nucleic acid molecule
agcaggttt

SEQ ID NO: 2891 - DNA, 9 bp, Artificial Sequence
  Synthetic nucleic acid molecule
gacagcctc

SEQ ID NO: 2892 - DNA, 9 bp, Artificial Sequence
  Synthetic nucleic acid molecule
agcagcaat

SEQ ID NO: 2893 - DNA, 9 bp, Artificial Sequence
  Synthetic nucleic acid molecule
ggcagcggt

SEQ ID NO: 2894 - DNA, 9 bp, Artificial Sequence
  Synthetic nucleic acid molecule
agtggagtc

SEQ ID NO: 2895 - DNA, 9 bp, Artificial Sequence
  Synthetic nucleic acid molecule
agcctggtc

SEQ ID NO: 2896 - DNA, 9 bp, Artificial Sequence
  Synthetic nucleic acid molecule
agaaccgac

SEQ ID NO: 2897 - DNA, 9 bp, Artificial Sequence
  Synthetic nucleic acid molecule
agcaacatg

SEQ ID NO: 2898 - DNA, 9 bp, Artificial Sequence
  Synthetic nucleic acid molecule
agctcagtc

SEQ ID NO: 2899 - DNA, 9 bp, Artificial Sequence
  Synthetic nucleic acid molecule
agctcagtc

SEQ ID NO: 2900 - DNA, 9 bp, Artificial Sequence
  Synthetic nucleic acid molecule
tgcaatgtc

SEQ ID NO: 2901 - DNA, 9 bp, Artificial Sequence
  Synthetic nucleic acid molecule
ggccccgtc

SEQ ID NO: 2902 - DNA, 9 bp, Artificial Sequence
  Synthetic nucleic acid molecule
agctcagtc

SEQ ID NO: 2903 - DNA, 9 bp, Artificial Sequence
  Synthetic nucleic acid molecule
agcaatgta

SEQ ID NO: 2904 - DNA, 9 bp, Artificial Sequence
  Synthetic nucleic acid molecule
agtaacatc

SEQ ID NO: 2905 - DNA, 9 bp, Artificial Sequence
  Synthetic nucleic acid molecule
atcattgtc

SEQ ID NO: 2906 - DNA, 9 bp, Artificial Sequence
  Synthetic nucleic acid molecule
agtagagtt

SEQ ID NO: 2907 - DNA, 9 bp, Artificial Sequence
  Synthetic nucleic acid molecule
agcaggggt

SEQ ID NO: 2908 - DNA, 9 bp, Artificial Sequence
  Synthetic nucleic acid molecule
tgctgtgtc

SEQ ID NO: 2909 - DNA, 9 bp, Artificial Sequence
  Synthetic nucleic acid molecule
attagagtc

SEQ ID NO: 2910 - DNA, 9 bp, Artificial Sequence
  Synthetic nucleic acid molecule
agaagggtg

SEQ ID NO: 2911 - DNA, 9 bp, Artificial Sequence
  Synthetic nucleic acid molecule
ctcagtgtc

SEQ ID NO: 2912 - DNA, 9 bp, Artificial Sequence
  Synthetic nucleic acid molecule
agctgtgtt

SEQ ID NO: 2913 - DNA, 9 bp, Artificial Sequence
  Synthetic nucleic acid molecule
agtacagtc

SEQ ID NO: 2914 - DNA, 9 bp, Artificial Sequence
  Synthetic nucleic acid molecule
agccgcttt

SEQ ID NO: 2915 - DNA, 9 bp, Artificial Sequence
  Synthetic nucleic acid molecule
accggtgtc

SEQ ID NO: 2916 - DNA, 9 bp, Artificial Sequence
  Synthetic nucleic acid molecule
agcagtgct

SEQ ID NO: 2917 - DNA, 9 bp, Artificial Sequence
  Synthetic nucleic acid molecule
agctcagtc

SEQ ID NO: 2918 - DNA, 9 bp, Artificial Sequence
  Synthetic nucleic acid molecule
atctgcatc

SEQ ID NO: 2919 - DNA, 9 bp, Artificial Sequence
  Synthetic nucleic acid molecule
agcacaatc

SEQ ID NO: 2920 - DNA, 9 bp, Artificial Sequence
  Synthetic nucleic acid molecule
agctcagtc

SEQ ID NO: 2921 - DNA, 9 bp, Artificial Sequence
  Synthetic nucleic acid molecule
atcatcatc

SEQ ID NO: 2922 - DNA, 9 bp, Artificial Sequence
  Synthetic nucleic acid molecule
ggtagagtc

SEQ ID NO: 2923 - DNA, 9 bp, Artificial Sequence
  Synthetic nucleic acid molecule
agctgtgtg

SEQ ID NO: 2924 - DNA, 9 bp, Artificial Sequence
  Synthetic nucleic acid molecule
atgagtgtc

SEQ ID NO: 2925 - DNA, 9 bp, Artificial Sequence
  Synthetic nucleic acid molecule
ggcagagtg

SEQ ID NO: 2926 - DNA, 9 bp, Artificial Sequence
  Synthetic nucleic acid molecule
aggagtctc

SEQ ID NO: 2927 - DNA, 9 bp, Artificial Sequence
  Synthetic nucleic acid molecule
agccaagtc

SEQ ID NO: 2928 - DNA, 9 bp, Artificial Sequence
  Synthetic nucleic acid molecule
cgctgagtc

SEQ ID NO: 2929 - DNA, 9 bp, Artificial Sequence
  Synthetic nucleic acid molecule
ggctccgtc

SEQ ID NO: 2930 - DNA, 9 bp, Artificial Sequence
  Synthetic nucleic acid molecule
agcagcagt

SEQ ID NO: 2931 - DNA, 9 bp, Artificial Sequence
  Synthetic nucleic acid molecule
agtactgtc

SEQ ID NO: 2932 - DNA, 9 bp, Artificial Sequence
  Synthetic nucleic acid molecule
atgagcggc

SEQ ID NO: 2933 - DNA, 9 bp, Artificial Sequence
  Synthetic nucleic acid molecule
tgcaaggtc

SEQ ID NO: 2934 - DNA, 9 bp, Artificial Sequence
  Synthetic nucleic acid molecule
agtacagtc

SEQ ID NO: 2935 - DNA, 9 bp, Artificial Sequence
  Synthetic nucleic acid molecule
atcattgtc

SEQ ID NO: 2936 - DNA, 9 bp, Artificial Sequence
  Synthetic nucleic acid molecule
ctcagcggc

SEQ ID NO: 2937 - DNA, 9 bp, Artificial Sequence
  Synthetic nucleic acid molecule
agcagtccc

SEQ ID NO: 2938 - DNA, 9 bp, Artificial Sequence
  Synthetic nucleic acid molecule
agcacaggc

SEQ ID NO: 2939 - DNA, 9 bp, Artificial Sequence
  Synthetic nucleic acid molecule
agcaaccac

SEQ ID NO: 2940 - DNA, 9 bp, Artificial Sequence
  Synthetic nucleic acid molecule
agtaaggtc

SEQ ID NO: 2941 - DNA, 9 bp, Artificial Sequence
  Synthetic nucleic acid molecule
cgccccgtc

SEQ ID NO: 2942 - DNA, 9 bp, Artificial Sequence
  Synthetic nucleic acid molecule
tgcacagtc

SEQ ID NO: 2943 - DNA, 9 bp, Artificial Sequence
  Synthetic nucleic acid molecule
agcagcaag

SEQ ID NO: 2944 - DNA, 9 bp, Artificial Sequence
  Synthetic nucleic acid molecule
agctcagtc

SEQ ID NO: 2945 - DNA, 9 bp, Artificial Sequence
  Synthetic nucleic acid molecule
ggcagggtt

SEQ ID NO: 2946 - DNA, 9 bp, Artificial Sequence
  Synthetic nucleic acid molecule
aggatggtc

SEQ ID NO: 2947 - DNA, 9 bp, Artificial Sequence
  Synthetic nucleic acid molecule
agcaacccc

SEQ ID NO: 2948 - DNA, 9 bp, Artificial Sequence
  Synthetic nucleic acid molecule
agaagccac

SEQ ID NO: 2949 - DNA, 9 bp, Artificial Sequence
  Synthetic nucleic acid molecule
accaatgtc

SEQ ID NO: 2950 - DNA, 9 bp, Artificial Sequence
  Synthetic nucleic acid molecule
aggtgcgtg

SEQ ID NO: 2951 - DNA, 9 bp, Artificial Sequence
  Synthetic nucleic acid molecule
agcagtgaa

SEQ ID NO: 2952 - DNA, 9 bp, Artificial Sequence
  Synthetic nucleic acid molecule
agctgagtg

SEQ ID NO: 2953 - DNA, 9 bp, Artificial Sequence
  Synthetic nucleic acid molecule
agcagtgcg

SEQ ID NO: 2954 - DNA, 9 bp, Artificial Sequence
  Synthetic nucleic acid molecule
ggcggggtc

SEQ ID NO: 2955 - DNA, 9 bp, Artificial Sequence
  Synthetic nucleic acid molecule
agaatagtc

SEQ ID NO: 2956 - DNA, 9 bp, Artificial Sequence
  Synthetic nucleic acid molecule
agcagggat

SEQ ID NO: 2957 - DNA, 9 bp, Artificial Sequence
  Synthetic nucleic acid molecule
ggaagtgtc

SEQ ID NO: 2958 - DNA, 9 bp, Artificial Sequence
  Synthetic nucleic acid molecule
atcaatgtc

SEQ ID NO: 2959 - DNA, 9 bp, Artificial Sequence
  Synthetic nucleic acid molecule
cccagcttc

SEQ ID NO: 2960 - DNA, 9 bp, Artificial Sequence
  Synthetic nucleic acid molecule
aggtgcggc

SEQ ID NO: 2961 - DNA, 9 bp, Artificial Sequence
  Synthetic nucleic acid molecule
agctgagac

SEQ ID NO: 2962 - DNA, 9 bp, Artificial Sequence
  Synthetic nucleic acid molecule
agcaacatg

SEQ ID NO: 2963 - DNA, 9 bp, Artificial Sequence
  Synthetic nucleic acid molecule
tgcgccgtc

SEQ ID NO: 2964 - DNA, 9 bp, Artificial Sequence
  Synthetic nucleic acid molecule
agcaaagtt

SEQ ID NO: 2965 - DNA, 9 bp, Artificial Sequence
  Synthetic nucleic acid molecule
agcaaagtt

SEQ ID NO: 2966 - DNA, 9 bp, Artificial Sequence
  Synthetic nucleic acid molecule
agcaaagtt

SEQ ID NO: 2967 - DNA, 9 bp, Artificial Sequence
  Synthetic nucleic acid molecule
agcaaagtt

SEQ ID NO: 2968 - DNA, 9 bp, Artificial Sequence
  Synthetic nucleic acid molecule
agcaaagtt

SEQ ID NO: 2969 - DNA, 9 bp, Artificial Sequence
  Synthetic nucleic acid molecule
agtatcatc

SEQ ID NO: 2970 - DNA, 9 bp, Artificial Sequence
  Synthetic nucleic acid molecule
agctgagac

SEQ ID NO: 2971 - DNA, 9 bp, Artificial Sequence
  Synthetic nucleic acid molecule
aggagcaac

SEQ ID NO: 2972 - DNA, 9 bp, Artificial Sequence
  Synthetic nucleic acid molecule
agcagctcg

SEQ ID NO: 2973 - DNA, 9 bp, Artificial Sequence
  Synthetic nucleic acid molecule
agctgagac

SEQ ID NO: 2974 - DNA, 9 bp, Artificial Sequence
  Synthetic nucleic acid molecule
agcaatgtg

SEQ ID NO: 2975 - DNA, 9 bp, Artificial Sequence
  Synthetic nucleic acid molecule
agaagcggt

SEQ ID NO: 2976 - DNA, 9 bp, Artificial Sequence
  Synthetic nucleic acid molecule
agaagtgcc

SEQ ID NO: 2977 - DNA, 9 bp, Artificial Sequence
  Synthetic nucleic acid molecule
ggatgagtc

SEQ ID NO: 2978 - DNA, 9 bp, Artificial Sequence
  Synthetic nucleic acid molecule
acaggtgtc

SEQ ID NO: 2979 - DNA, 9 bp, Artificial Sequence
  Synthetic nucleic acid molecule
ctgggcgtc

SEQ ID NO: 2980 - DNA, 9 bp, Artificial Sequence
  Synthetic nucleic acid molecule
cccggggtc

SEQ ID NO: 2981 - DNA, 9 bp, Artificial Sequence
  Synthetic nucleic acid molecule
tggcacgtc

SEQ ID NO: 2982 - DNA, 9 bp, Artificial Sequence
  Synthetic nucleic acid molecule
agctcagta

SEQ ID NO: 2983 - DNA, 9 bp, Artificial Sequence
  Synthetic nucleic acid molecule
aaaaggttc

SEQ ID NO: 2984 - DNA, 9 bp, Artificial Sequence
  Synthetic nucleic acid molecule
gacatcatc

SEQ ID NO: 2985 - DNA, 9 bp, Artificial Sequence
  Synthetic nucleic acid molecule
agcactatt

SEQ ID NO: 2986 - DNA, 9 bp, Artificial Sequence
  Synthetic nucleic acid molecule
ccctgagtc

SEQ ID NO: 2987 - DNA, 9 bp, Artificial Sequence
  Synthetic nucleic acid molecule
tggggagtc

SEQ ID NO: 2988 - DNA, 9 bp, Artificial Sequence
  Synthetic nucleic acid molecule
aacagggct

SEQ ID NO: 2989 - DNA, 9 bp, Artificial Sequence
  Synthetic nucleic acid molecule
agcaaagct

SEQ ID NO: 2990 - DNA, 9 bp, Artificial Sequence
  Synthetic nucleic acid molecule
aacattgtt

SEQ ID NO: 2991 - DNA, 9 bp, Artificial Sequence
  Synthetic nucleic acid molecule
agacacttc

SEQ ID NO: 2992 - DNA, 9 bp, Artificial Sequence
  Synthetic nucleic acid molecule
gcccacgtc

SEQ ID NO: 2993 - DNA, 9 bp, Artificial Sequence
  Synthetic nucleic acid molecule
aacatggtt

SEQ ID NO: 2994 - DNA, 9 bp, Artificial Sequence
  Synthetic nucleic acid molecule
ggtacagtc

SEQ ID NO: 2995 - DNA, 9 bp, Artificial Sequence
  Synthetic nucleic acid molecule
ggcatggtg

SEQ ID NO: 2996 - DNA, 9 bp, Artificial Sequence
  Synthetic nucleic acid molecule
ggaagtctc

SEQ ID NO: 2997 - DNA, 9 bp, Artificial Sequence
  Synthetic nucleic acid molecule
atcttggtc

SEQ ID NO: 2998 - DNA, 9 bp, Artificial Sequence
  Synthetic nucleic acid molecule
atcaggtcc

SEQ ID NO: 2999 - DNA, 9 bp, Artificial Sequence
  Synthetic nucleic acid molecule
ggcatggtg

SEQ ID NO: 3000 - DNA, 9 bp, Artificial Sequence
  Synthetic nucleic acid molecule
tgaaacgtt

SEQ ID NO: 3001 - DNA, 9 bp, Artificial Sequence
  Synthetic nucleic acid molecule
tgaatcggc

SEQ ID NO: 3002 - DNA, 9 bp, Artificial Sequence
  Synthetic nucleic acid molecule
atacacgtc

SEQ ID NO: 3003 - DNA, 9 bp, Artificial Sequence
  Synthetic nucleic acid molecule
gggaaggtc

SEQ ID NO: 3004 - DNA, 9 bp, Artificial Sequence
  Synthetic nucleic acid molecule
cactgtgtc

SEQ ID NO: 3005 - DNA, 9 bp, Artificial Sequence
  Synthetic nucleic acid molecule
atctttgtc

SEQ ID NO: 3006 - DNA, 9 bp, Artificial Sequence
  Synthetic nucleic acid molecule
ctgagggtc

SEQ ID NO: 3007 - DNA, 9 bp, Artificial Sequence
  Synthetic nucleic acid molecule
atgtgagtc

SEQ ID NO: 3008 - DNA, 9 bp, Artificial Sequence
  Synthetic nucleic acid molecule
aaagtcgtc

SEQ ID NO: 3009 - DNA, 9 bp, Artificial Sequence
  Synthetic nucleic acid molecule
aacaatgtt

SEQ ID NO: 3010 - DNA, 9 bp, Artificial Sequence
  Synthetic nucleic acid molecule
gggaaggtc

SEQ ID NO: 3011 - DNA, 9 bp, Artificial Sequence
  Synthetic nucleic acid molecule
ggatgtgtc

SEQ ID NO: 3012 - DNA, 9 bp, Artificial Sequence
  Synthetic nucleic acid molecule
tccacagtc

SEQ ID NO: 3013 - DNA, 9 bp, Artificial Sequence
  Synthetic nucleic acid molecule
agcaaagct

SEQ ID NO: 3014 - DNA, 9 bp, Artificial Sequence
  Synthetic nucleic acid molecule
ccctgggtc

SEQ ID NO: 3015 - DNA, 9 bp, Artificial Sequence
  Synthetic nucleic acid molecule
gtgagggtc

SEQ ID NO: 3016 - DNA, 9 bp, Artificial Sequence
  Synthetic nucleic acid molecule
agccaggtt

SEQ ID NO: 3017 - DNA, 9 bp, Artificial Sequence
  Synthetic nucleic acid molecule
agcatggct

SEQ ID NO: 3018 - DNA, 9 bp, Artificial Sequence
  Synthetic nucleic acid molecule
agctcaggc

SEQ ID NO: 3019 - DNA, 9 bp, Artificial Sequence
  Synthetic nucleic acid molecule
ccctgggtc

SEQ ID NO: 3020 - DNA, 9 bp, Artificial Sequence
  Synthetic nucleic acid molecule
agcaacaga

SEQ ID NO: 3021 - DNA, 9 bp, Artificial Sequence
  Synthetic nucleic acid molecule
agcatggct

SEQ ID NO: 3022 - DNA, 9 bp, Artificial Sequence
  Synthetic nucleic acid molecule
agctaagtt

SEQ ID NO: 3023 - DNA, 9 bp, Artificial Sequence
  Synthetic nucleic acid molecule
aactttgtc

SEQ ID NO: 3024 - DNA, 9 bp, Artificial Sequence
  Synthetic nucleic acid molecule
aacatggtt

SEQ ID NO: 3025 - DNA, 9 bp, Artificial Sequence
  Synthetic nucleic acid molecule
cgccacggc

SEQ ID NO: 3026 - DNA, 9 bp, Artificial Sequence
  Synthetic nucleic acid molecule
ctcattgtc

SEQ ID NO: 3027 - DNA, 9 bp, Artificial Sequence
  Synthetic nucleic acid molecule
ccctgggtc

SEQ ID NO: 3028 - DNA, 9 bp, Artificial Sequence
  Synthetic nucleic acid molecule
agcaacgtc

SEQ ID NO: 3029 - DNA, 9 bp, Artificial Sequence
  Synthetic nucleic acid molecule
agcagcggc

SEQ ID NO: 3030 - DNA, 9 bp, Artificial Sequence
  Synthetic nucleic acid molecule
agcagcggc

SEQ ID NO: 3031 - DNA, 9 bp, Artificial Sequence
  Synthetic nucleic acid molecule
agcagcggc

SEQ ID NO: 3032 - DNA, 9 bp, Artificial Sequence
  Synthetic nucleic acid molecule
agcaccgtc

SEQ ID NO: 3033 - DNA, 9 bp, Artificial Sequence
  Synthetic nucleic acid molecule
agcaccgtc

SEQ ID NO: 3034 - DNA, 9 bp, Artificial Sequence
  Synthetic nucleic acid molecule
agcacagtc

SEQ ID NO: 3035 - DNA, 9 bp, Artificial Sequence
  Synthetic nucleic acid molecule
agcaacgta

SEQ ID NO: 3036 - DNA, 9 bp, Artificial Sequence
  Synthetic nucleic acid molecule
agcatcggc

SEQ ID NO: 3037 - DNA, 9 bp, Artificial Sequence
  Synthetic nucleic acid molecule
aacaacgtc

SEQ ID NO: 3038 - DNA, 9 bp, Artificial Sequence
  Synthetic nucleic acid molecule
agcatagtc

SEQ ID NO: 3039 - DNA, 9 bp, Artificial Sequence
  Synthetic nucleic acid molecule
agcatggtc

SEQ ID NO: 3040 - DNA, 9 bp, Artificial Sequence
  Synthetic nucleic acid molecule
agctgtgtc

SEQ ID NO: 3041 - DNA, 9 bp, Artificial Sequence
  Synthetic nucleic acid molecule
agcaatgtc

SEQ ID NO: 3042 - DNA, 9 bp, Artificial Sequence
  Synthetic nucleic acid molecule
agcattgtc

SEQ ID NO: 3043 - DNA, 9 bp, Artificial Sequence
  Synthetic nucleic acid molecule
agcagctgc

SEQ ID NO: 3044 - DNA, 9 bp, Artificial Sequence
  Synthetic nucleic acid molecule
tgcagtgtc

SEQ ID NO: 3045 - DNA, 9 bp, Artificial Sequence
  Synthetic nucleic acid molecule
agcattgtc

SEQ ID NO: 3046 - DNA, 9 bp, Artificial Sequence
  Synthetic nucleic acid molecule
agcattgtc

SEQ ID NO: 3047 - DNA, 9 bp, Artificial Sequence
  Synthetic nucleic acid molecule
agcaatgtc

SEQ ID NO: 3048 - DNA, 9 bp, Artificial Sequence
  Synthetic nucleic acid molecule
agcaacgtt

SEQ ID NO: 3049 - DNA, 9 bp, Artificial Sequence
  Synthetic nucleic acid molecule
agcaacttc

SEQ ID NO: 3050 - DNA, 9 bp, Artificial Sequence
  Synthetic nucleic acid molecule
aggcgagtc

SEQ ID NO: 3051 - DNA, 9 bp, Artificial Sequence
  Synthetic nucleic acid molecule
agccacgtt

SEQ ID NO: 3052 - DNA, 9 bp, Artificial Sequence
  Synthetic nucleic acid molecule
agtatcgtg

SEQ ID NO: 3053 - DNA, 9 bp, Artificial Sequence
  Synthetic nucleic acid molecule
agcaaggta

SEQ ID NO: 3054 - DNA, 9 bp, Artificial Sequence
  Synthetic nucleic acid molecule
tgcagctgc

SEQ ID NO: 3055 - DNA, 9 bp, Artificial Sequence
  Synthetic nucleic acid molecule
agtatcttc

SEQ ID NO: 3056 - DNA, 9 bp, Artificial Sequence
  Synthetic nucleic acid molecule
tgcagtttc

SEQ ID NO: 3057 - DNA, 9 bp, Artificial Sequence
  Synthetic nucleic acid molecule
atcaggggc

SEQ ID NO: 3058 - DNA, 9 bp, Artificial Sequence
  Synthetic nucleic acid molecule
agttgcttc

SEQ ID NO: 3059 - DNA, 9 bp, Artificial Sequence
  Synthetic nucleic acid molecule
agctacgtg

SEQ ID NO: 3060 - DNA, 9 bp, Artificial Sequence
  Synthetic nucleic acid molecule
agcttagtc

SEQ ID NO: 3061 - DNA, 9 bp, Artificial Sequence
  Synthetic nucleic acid molecule
atcaggggc

SEQ ID NO: 3062 - DNA, 9 bp, Artificial Sequence
  Synthetic nucleic acid molecule
atcaggggc

SEQ ID NO: 3063 - DNA, 9 bp, Artificial Sequence
  Synthetic nucleic acid molecule
agcaacccc

SEQ ID NO: 3064 - DNA, 9 bp, Artificial Sequence
  Synthetic nucleic acid molecule
agcatggta

SEQ ID NO: 3065 - DNA, 9 bp, Artificial Sequence
  Synthetic nucleic acid molecule
catagcgtc

SEQ ID NO: 3066 - DNA, 9 bp, Artificial Sequence
  Synthetic nucleic acid molecule
tgcagctgc

SEQ ID NO: 3067 - DNA, 9 bp, Artificial Sequence
  Synthetic nucleic acid molecule
agctaggtc

SEQ ID NO: 3068 - DNA, 9 bp, Artificial Sequence
  Synthetic nucleic acid molecule
agcttggtc

SEQ ID NO: 3069 - DNA, 9 bp, Artificial Sequence
  Synthetic nucleic acid molecule
agcaactac

SEQ ID NO: 3070 - DNA, 9 bp, Artificial Sequence
  Synthetic nucleic acid molecule
agcaacccc

SEQ ID NO: 3071 - DNA, 9 bp, Artificial Sequence
  Synthetic nucleic acid molecule
gtcagtgtc

SEQ ID NO: 3072 - DNA, 9 bp, Artificial Sequence
  Synthetic nucleic acid molecule
tgcagtgta

SEQ ID NO: 3073 - DNA, 9 bp, Artificial Sequence
  Synthetic nucleic acid molecule
ctcatcgtc

SEQ ID NO: 3074 - DNA, 9 bp, Artificial Sequence
  Synthetic nucleic acid molecule
agtaacatc

SEQ ID NO: 3075 - DNA, 9 bp, Artificial Sequence
  Synthetic nucleic acid molecule
agctatgtc

SEQ ID NO: 3076 - DNA, 9 bp, Artificial Sequence
  Synthetic nucleic acid molecule
gtccgcgtc

SEQ ID NO: 3077 - DNA, 9 bp, Artificial Sequence
  Synthetic nucleic acid molecule
agccttgtc

SEQ ID NO: 3078 - DNA, 9 bp, Artificial Sequence
  Synthetic nucleic acid molecule
agcacagcc

SEQ ID NO: 3079 - DNA, 9 bp, Artificial Sequence
  Synthetic nucleic acid molecule
agcaacatt

SEQ ID NO: 3080 - DNA, 9 bp, Artificial Sequence
  Synthetic nucleic acid molecule
agtgtggtc

SEQ ID NO: 3081 - DNA, 9 bp, Artificial Sequence
  Synthetic nucleic acid molecule
actaatgtc

SEQ ID NO: 3082 - DNA, 9 bp, Artificial Sequence
  Synthetic nucleic acid molecule
tacattgtc

SEQ ID NO: 3083 - DNA, 9 bp, Artificial Sequence
  Synthetic nucleic acid molecule
atcaatggc

SEQ ID NO: 3084 - DNA, 9 bp, Artificial Sequence
  Synthetic nucleic acid molecule
cggggagtc

SEQ ID NO: 3085 - DNA, 9 bp, Artificial Sequence
  Synthetic nucleic acid molecule
agcaggtca

SEQ ID NO: 3086 - DNA, 9 bp, Artificial Sequence
  Synthetic nucleic acid molecule
agctaggtt

SEQ ID NO: 3087 - DNA, 9 bp, Artificial Sequence
  Synthetic nucleic acid molecule
agtgtggtc

SEQ ID NO: 3088 - DNA, 9 bp, Artificial Sequence
  Synthetic nucleic acid molecule
agtatggta

SEQ ID NO: 3089 - DNA, 9 bp, Artificial Sequence
  Synthetic nucleic acid molecule
atccgtctc

SEQ ID NO: 3090 - DNA, 9 bp, Artificial Sequence
  Synthetic nucleic acid molecule
aacagtatt

SEQ ID NO: 3091 - DNA, 9 bp, Artificial Sequence
  Synthetic nucleic acid molecule
atcagcagt

SEQ ID NO: 3092 - DNA, 9 bp, Artificial Sequence
  Synthetic nucleic acid molecule
ggccaagtc

SEQ ID NO: 3093 - DNA, 9 bp, Artificial Sequence
  Synthetic nucleic acid molecule
gccagtgtt

SEQ ID NO: 3094 - DNA, 9 bp, Artificial Sequence
  Synthetic nucleic acid molecule
atcagggca

SEQ ID NO: 3095 - DNA, 9 bp, Artificial Sequence
  Synthetic nucleic acid molecule
agtagatgc

SEQ ID NO: 3096 - DNA, 9 bp, Artificial Sequence
  Synthetic nucleic acid molecule
ggcctggtc

SEQ ID NO: 3097 - DNA, 9 bp, Artificial Sequence
  Synthetic nucleic acid molecule
agcaactca

SEQ ID NO: 3098 - DNA, 9 bp, Artificial Sequence
  Synthetic nucleic acid molecule
gggggagtc

SEQ ID NO: 3099 - DNA, 9 bp, Artificial Sequence
  Synthetic nucleic acid molecule
atcagtcta

SEQ ID NO: 3100 - DNA, 9 bp, Artificial Sequence
  Synthetic nucleic acid molecule
agtagatgc

SEQ ID NO: 3101 - DNA, 9 bp, Artificial Sequence
  Synthetic nucleic acid molecule
accagtggt

SEQ ID NO: 3102 - DNA, 9 bp, Artificial Sequence
  Synthetic nucleic acid molecule
ggccttgtc

SEQ ID NO: 3103 - DNA, 9 bp, Artificial Sequence
  Synthetic nucleic acid molecule
ctcattgtc

SEQ ID NO: 3104 - DNA, 9 bp, Artificial Sequence
  Synthetic nucleic acid molecule
agtatggta

SEQ ID NO: 3105 - DNA, 9 bp, Artificial Sequence
  Synthetic nucleic acid molecule
agagaggtc

SEQ ID NO: 3106 - DNA, 9 bp, Artificial Sequence
  Synthetic nucleic acid molecule
ggcctggtc

SEQ ID NO: 3107 - DNA, 9 bp, Artificial Sequence
  Synthetic nucleic acid molecule
tgttgagtc

SEQ ID NO: 3108 - DNA, 9 bp, Artificial Sequence
  Synthetic nucleic acid molecule
agcaccact

SEQ ID NO: 3109 - DNA, 9 bp, Artificial Sequence
  Synthetic nucleic acid molecule
aaaacagtc

SEQ ID NO: 3110 - DNA, 9 bp, Artificial Sequence
  Synthetic nucleic acid molecule
aacagtatt

SEQ ID NO: 3111 - DNA, 9 bp, Artificial Sequence
  Synthetic nucleic acid molecule
gccaacatc

SEQ ID NO: 3112 - DNA, 9 bp, Artificial Sequence
  Synthetic nucleic acid molecule
ggccaagtc

SEQ ID NO: 3113 - DNA, 9 bp, Artificial Sequence
  Synthetic nucleic acid molecule
aaaacagtc

SEQ ID NO: 3114 - DNA, 9 bp, Artificial Sequence
  Synthetic nucleic acid molecule
aatcccgtc

SEQ ID NO: 3115 - DNA, 9 bp, Artificial Sequence
  Synthetic nucleic acid molecule
ggttacgtc

SEQ ID NO: 3116 - DNA, 9 bp, Artificial Sequence
  Synthetic nucleic acid molecule
agttacttc

SEQ ID NO: 3117 - DNA, 9 bp, Artificial Sequence
  Synthetic nucleic acid molecule
agttacttc

SEQ ID NO: 3118 - DNA, 9 bp, Artificial Sequence
  Synthetic nucleic acid molecule
ggcatcgtc

SEQ ID NO: 3119 - DNA, 9 bp, Artificial Sequence
  Synthetic nucleic acid molecule
atcagggtc

SEQ ID NO: 3120 - DNA, 9 bp, Artificial Sequence
  Synthetic nucleic acid molecule
agctcagtc

SEQ ID NO: 3121 - DNA, 9 bp, Artificial Sequence
  Synthetic nucleic acid molecule
agctcagtc

SEQ ID NO: 3122 - DNA, 9 bp, Artificial Sequence
  Synthetic nucleic acid molecule
agcatggtt

SEQ ID NO: 3123 - DNA, 9 bp, Artificial Sequence
  Synthetic nucleic acid molecule
agatgggtc

SEQ ID NO: 3124 - DNA, 9 bp, Artificial Sequence
  Synthetic nucleic acid molecule
agatgggtc

SEQ ID NO: 3125 - DNA, 9 bp, Artificial Sequence
  Synthetic nucleic acid molecule
agcagagtc

SEQ ID NO: 3126 - DNA, 9 bp, Artificial Sequence
  Synthetic nucleic acid molecule
agcagagtc

SEQ ID NO: 3127 - DNA, 9 bp, Artificial Sequence
  Synthetic nucleic acid molecule
agcagcgtc

SEQ ID NO: 3128 - DNA, 9 bp, Artificial Sequence
  Synthetic nucleic acid molecule
agcagcgtc

SEQ ID NO: 3129 - DNA, 9 bp, Artificial Sequence
  Synthetic nucleic acid molecule
agcagcgtc

SEQ ID NO: 3130 - DNA, 9 bp, Artificial Sequence
  Synthetic nucleic acid molecule
agcagcgtc

SEQ ID NO: 3131 - DNA, 9 bp, Artificial Sequence
  Synthetic nucleic acid molecule
agcagtgtc

SEQ ID NO: 3132 - DNA, 9 bp, Artificial Sequence
  Synthetic nucleic acid molecule
agcagcttc

SEQ ID NO: 3133 - DNA, 9 bp, Artificial Sequence
  Synthetic nucleic acid molecule
agcagtgtc

SEQ ID NO: 3134 - DNA, 9 bp, Artificial Sequence
  Synthetic nucleic acid molecule
tgcagcgtc

SEQ ID NO: 3135 - DNA, 9 bp, Artificial Sequence
  Synthetic nucleic acid molecule
agcagtgtc

SEQ ID NO: 3136 - DNA, 9 bp, Artificial Sequence
  Synthetic nucleic acid molecule
agcagcttc

SEQ ID NO: 3137 - DNA, 9 bp, Artificial Sequence
  Synthetic nucleic acid molecule
agcagtgtc

SEQ ID NO: 3138 - DNA, 9 bp, Artificial Sequence
  Synthetic nucleic acid molecule
agcagcttc

SEQ ID NO: 3139 - DNA, 9 bp, Artificial Sequence
  Synthetic nucleic acid molecule
agcagcgtg

SEQ ID NO: 3140 - DNA, 9 bp, Artificial Sequence
  Synthetic nucleic acid molecule
agcagcgtt

SEQ ID NO: 3141 - DNA, 9 bp, Artificial Sequence
  Synthetic nucleic acid molecule
agaagcgtc

SEQ ID NO: 3142 - DNA, 9 bp, Artificial Sequence
  Synthetic nucleic acid molecule
agcagcatc

SEQ ID NO: 3143 - DNA, 9 bp, Artificial Sequence
  Synthetic nucleic acid molecule
agcagcggc

SEQ ID NO: 3144 - DNA, 9 bp, Artificial Sequence
  Synthetic nucleic acid molecule
agcatcgtc

SEQ ID NO: 3145 - DNA, 9 bp, Artificial Sequence
  Synthetic nucleic acid molecule
agcagcttc

SEQ ID NO: 3146 - DNA, 9 bp, Artificial Sequence
  Synthetic nucleic acid molecule
agcagcgtt

SEQ ID NO: 3147 - DNA, 9 bp, Artificial Sequence
  Synthetic nucleic acid molecule
agcagcatc

SEQ ID NO: 3148 - DNA, 9 bp, Artificial Sequence
  Synthetic nucleic acid molecule
agcagggtc

SEQ ID NO: 3149 - DNA, 9 bp, Artificial Sequence
  Synthetic nucleic acid molecule
agcagggtc

SEQ ID NO: 3150 - DNA, 9 bp, Artificial Sequence
  Synthetic nucleic acid molecule
agcagcgcc

SEQ ID NO: 3151 - DNA, 9 bp, Artificial Sequence
  Synthetic nucleic acid molecule
agcaccgtc

SEQ ID NO: 3152 - DNA, 9 bp, Artificial Sequence
  Synthetic nucleic acid molecule
agcagagtc

SEQ ID NO: 3153 - DNA, 9 bp, Artificial Sequence
  Synthetic nucleic acid molecule
agcagcgtg

SEQ ID NO: 3154 - DNA, 9 bp, Artificial Sequence
  Synthetic nucleic acid molecule
agcagggtc

SEQ ID NO: 3155 - DNA, 9 bp, Artificial Sequence
  Synthetic nucleic acid molecule
agcagggtc

SEQ ID NO: 3156 - DNA, 9 bp, Artificial Sequence
  Synthetic nucleic acid molecule
ggcagcgtc

SEQ ID NO: 3157 - DNA, 9 bp, Artificial Sequence
  Synthetic nucleic acid molecule
agcagtgtc

SEQ ID NO: 3158 - DNA, 9 bp, Artificial Sequence
  Synthetic nucleic acid molecule
agcagcctc

SEQ ID NO: 3159 - DNA, 9 bp, Artificial Sequence
  Synthetic nucleic acid molecule
agcagcgtt

SEQ ID NO: 3160 - DNA, 9 bp, Artificial Sequence
  Synthetic nucleic acid molecule
agcagcgac

SEQ ID NO: 3161 - DNA, 9 bp, Artificial Sequence
  Synthetic nucleic acid molecule
agcagagtc

SEQ ID NO: 3162 - DNA, 9 bp, Artificial Sequence
  Synthetic nucleic acid molecule
agcagcatc

SEQ ID NO: 3163 - DNA, 9 bp, Artificial Sequence
  Synthetic nucleic acid molecule
agctgagtc

SEQ ID NO: 3164 - DNA, 9 bp, Artificial Sequence
  Synthetic nucleic acid molecule
ggcagtgtc

SEQ ID NO: 3165 - DNA, 9 bp, Artificial Sequence
  Synthetic nucleic acid molecule
agcaacttc

SEQ ID NO: 3166 - DNA, 9 bp, Artificial Sequence
  Synthetic nucleic acid molecule
agcatcttc

SEQ ID NO: 3167 - DNA, 9 bp, Artificial Sequence
  Synthetic nucleic acid molecule
ggcagggtc

SEQ ID NO: 3168 - DNA, 9 bp, Artificial Sequence
  Synthetic nucleic acid molecule
agcagtgtg

SEQ ID NO: 3169 - DNA, 9 bp, Artificial Sequence
  Synthetic nucleic acid molecule
agcagtgta

SEQ ID NO: 3170 - DNA, 9 bp, Artificial Sequence
  Synthetic nucleic acid molecule
agctgggtc

SEQ ID NO: 3171 - DNA, 9 bp, Artificial Sequence
  Synthetic nucleic acid molecule
agcagcgag

SEQ ID NO: 3172 - DNA, 9 bp, Artificial Sequence
  Synthetic nucleic acid molecule
agcagcttg

SEQ ID NO: 3173 - DNA, 9 bp, Artificial Sequence
  Synthetic nucleic acid molecule
agcagcagc

SEQ ID NO: 3174 - DNA, 9 bp, Artificial Sequence
  Synthetic nucleic acid molecule
agcaccatc

SEQ ID NO: 3175 - DNA, 9 bp, Artificial Sequence
  Synthetic nucleic acid molecule
agcagagtt

SEQ ID NO: 3176 - DNA, 9 bp, Artificial Sequence
  Synthetic nucleic acid molecule
ggcagggtc

SEQ ID NO: 3177 - DNA, 9 bp, Artificial Sequence
  Synthetic nucleic acid molecule
ggcagtgtc

SEQ ID NO: 3178 - DNA, 9 bp, Artificial Sequence
  Synthetic nucleic acid molecule
tgcaacgtc

SEQ ID NO: 3179 - DNA, 9 bp, Artificial Sequence
  Synthetic nucleic acid molecule
aacagtgtc

SEQ ID NO: 3180 - DNA, 9 bp, Artificial Sequence
  Synthetic nucleic acid molecule
agcagtgta

SEQ ID NO: 3181 - DNA, 9 bp, Artificial Sequence
  Synthetic nucleic acid molecule
agctgtgtc

SEQ ID NO: 3182 - DNA, 9 bp, Artificial Sequence
  Synthetic nucleic acid molecule
agcagcgga

SEQ ID NO: 3183 - DNA, 9 bp, Artificial Sequence
  Synthetic nucleic acid molecule
aacagcttc

SEQ ID NO: 3184 - DNA, 9 bp, Artificial Sequence
  Synthetic nucleic acid molecule
agtagagtc

SEQ ID NO: 3185 - DNA, 9 bp, Artificial Sequence
  Synthetic nucleic acid molecule
agcagcgaa

SEQ ID NO: 3186 - DNA, 9 bp, Artificial Sequence
  Synthetic nucleic acid molecule
aactgcgtc

SEQ ID NO: 3187 - DNA, 9 bp, Artificial Sequence
  Synthetic nucleic acid molecule
agaagcctc

SEQ ID NO: 3188 - DNA, 9 bp, Artificial Sequence
  Synthetic nucleic acid molecule
agcagtgtg

SEQ ID NO: 3189 - DNA, 9 bp, Artificial Sequence
  Synthetic nucleic acid molecule
agtagagtc

SEQ ID NO: 3190 - DNA, 9 bp, Artificial Sequence
  Synthetic nucleic acid molecule
ggcagtgtc

SEQ ID NO: 3191 - DNA, 9 bp, Artificial Sequence
  Synthetic nucleic acid molecule
agcactgtc

SEQ ID NO: 3192 - DNA, 9 bp, Artificial Sequence
  Synthetic nucleic acid molecule
agctgggtc

SEQ ID NO: 3193 - DNA, 9 bp, Artificial Sequence
  Synthetic nucleic acid molecule
agcagcttt

SEQ ID NO: 3194 - DNA, 9 bp, Artificial Sequence
  Synthetic nucleic acid molecule
agcagtgta

SEQ ID NO: 3195 - DNA, 9 bp, Artificial Sequence
  Synthetic nucleic acid molecule
ggcagcgtg

SEQ ID NO: 3196 - DNA, 9 bp, Artificial Sequence
  Synthetic nucleic acid molecule
agcagcagc

SEQ ID NO: 3197 - DNA, 9 bp, Artificial Sequence
  Synthetic nucleic acid molecule
agtagcttc

SEQ ID NO: 3198 - DNA, 9 bp, Artificial Sequence
  Synthetic nucleic acid molecule
tgcggcgtc

SEQ ID NO: 3199 - DNA, 9 bp, Artificial Sequence
  Synthetic nucleic acid molecule
aacagagtc

SEQ ID NO: 3200 - DNA, 9 bp, Artificial Sequence
  Synthetic nucleic acid molecule
ggcagcggc

SEQ ID NO: 3201 - DNA, 9 bp, Artificial Sequence
  Synthetic nucleic acid molecule
agcaggctc

SEQ ID NO: 3202 - DNA, 9 bp, Artificial Sequence
  Synthetic nucleic acid molecule
atcaccatc

SEQ ID NO: 3203 - DNA, 9 bp, Artificial Sequence
  Synthetic nucleic acid molecule
agcagttta

SEQ ID NO: 3204 - DNA, 9 bp, Artificial Sequence
  Synthetic nucleic acid molecule
aacagcaac

SEQ ID NO: 3205 - DNA, 9 bp, Artificial Sequence
  Synthetic nucleic acid molecule
agctgagta

SEQ ID NO: 3206 - DNA, 9 bp, Artificial Sequence
  Synthetic nucleic acid molecule
agcaacctg

SEQ ID NO: 3207 - DNA, 9 bp, Artificial Sequence
  Synthetic nucleic acid molecule
agcaacctg

SEQ ID NO: 3208 - DNA, 9 bp, Artificial Sequence
  Synthetic nucleic acid molecule
tgcaggctc

SEQ ID NO: 3209 - DNA, 9 bp, Artificial Sequence
  Synthetic nucleic acid molecule
cgcagtatc

SEQ ID NO: 3210 - DNA, 9 bp, Artificial Sequence
  Synthetic nucleic acid molecule
agaaacatc

SEQ ID NO: 3211 - DNA, 9 bp, Artificial Sequence
  Synthetic nucleic acid molecule
acctgtgtc

SEQ ID NO: 3212 - DNA, 9 bp, Artificial Sequence
  Synthetic nucleic acid molecule
ggcagggcc

SEQ ID NO: 3213 - DNA, 9 bp, Artificial Sequence
  Synthetic nucleic acid molecule
agaaacatc

SEQ ID NO: 3214 - DNA, 9 bp, Artificial Sequence
  Synthetic nucleic acid molecule
aggtgcatc

SEQ ID NO: 3215 - DNA, 9 bp, Artificial Sequence
  Synthetic nucleic acid molecule
ggcagggcc

SEQ ID NO: 3216 - DNA, 9 bp, Artificial Sequence
  Synthetic nucleic acid molecule
ggcagctgc

SEQ ID NO: 3217 - DNA, 9 bp, Artificial Sequence
  Synthetic nucleic acid molecule
agcatggcc

SEQ ID NO: 3218 - DNA, 9 bp, Artificial Sequence
  Synthetic nucleic acid molecule
agcagcgtc

SEQ ID NO: 3219 - DNA, 9 bp, Artificial Sequence
  Synthetic nucleic acid molecule
agcagcgtc

SEQ ID NO: 3220 - DNA, 9 bp, Artificial Sequence
  Synthetic nucleic acid molecule
agcagcgtc

SEQ ID NO: 3221 - DNA, 9 bp, Artificial Sequence
  Synthetic nucleic acid molecule
agcagcgtc

SEQ ID NO: 3222 - DNA, 9 bp, Artificial Sequence
  Synthetic nucleic acid molecule
agcaacgtc

SEQ ID NO: 3223 - DNA, 9 bp, Artificial Sequence
  Synthetic nucleic acid molecule
agcagggtc

SEQ ID NO: 3224 - DNA, 9 bp, Artificial Sequence
  Synthetic nucleic acid molecule
agcagcgtg

SEQ ID NO: 3225 - DNA, 9 bp, Artificial Sequence
  Synthetic nucleic acid molecule
agcagcgtt

SEQ ID NO: 3226 - DNA, 9 bp, Artificial Sequence
  Synthetic nucleic acid molecule
agcaacgtc

SEQ ID NO: 3227 - DNA, 9 bp, Artificial Sequence
  Synthetic nucleic acid molecule
agcagggtc

SEQ ID NO: 3228 - DNA, 9 bp, Artificial Sequence
  Synthetic nucleic acid molecule
agcagtgtc

SEQ ID NO: 3229 - DNA, 9 bp, Artificial Sequence
  Synthetic nucleic acid molecule
agcaacgtc

SEQ ID NO: 3230 - DNA, 9 bp, Artificial Sequence
  Synthetic nucleic acid molecule
agcatcgtc

SEQ ID NO: 3231 - DNA, 9 bp, Artificial Sequence
  Synthetic nucleic acid molecule
agcagcttc

SEQ ID NO: 3232 - DNA, 9 bp, Artificial Sequence
  Synthetic nucleic acid molecule
agcaacgtc

SEQ ID NO: 3233 - DNA, 9 bp, Artificial Sequence
  Synthetic nucleic acid molecule
agcagcgtt

SEQ ID NO: 3234 - DNA, 9 bp, Artificial Sequence
  Synthetic nucleic acid molecule
agcagcgtt

SEQ ID NO: 3235 - DNA, 9 bp, Artificial Sequence
  Synthetic nucleic acid molecule
agcagggtc

SEQ ID NO: 3236 - DNA, 9 bp, Artificial Sequence
  Synthetic nucleic acid molecule
agcagtgtc

SEQ ID NO: 3237 - DNA, 9 bp, Artificial Sequence
  Synthetic nucleic acid molecule
agcagtgtc

SEQ ID NO: 3238 - DNA, 9 bp, Artificial Sequence
  Synthetic nucleic acid molecule
agcagcttc

SEQ ID NO: 3239 - DNA, 9 bp, Artificial Sequence
  Synthetic nucleic acid molecule
ggcagcgtc

SEQ ID NO: 3240 - DNA, 9 bp, Artificial Sequence
  Synthetic nucleic acid molecule
agcagcttc

SEQ ID NO: 3241 - DNA, 9 bp, Artificial Sequence
  Synthetic nucleic acid molecule
agcagggtc

SEQ ID NO: 3242 - DNA, 9 bp, Artificial Sequence
  Synthetic nucleic acid molecule
agcagcggc

SEQ ID NO: 3243 - DNA, 9 bp, Artificial Sequence
  Synthetic nucleic acid molecule
agcagcctc

SEQ ID NO: 3244 - DNA, 9 bp, Artificial Sequence
  Synthetic nucleic acid molecule
agcaacgtc

SEQ ID NO: 3245 - DNA, 9 bp, Artificial Sequence
  Synthetic nucleic acid molecule
agcagcgtg

SEQ ID NO: 3246 - DNA, 9 bp, Artificial Sequence
  Synthetic nucleic acid molecule
agcagggtc

SEQ ID NO: 3247 - DNA, 9 bp, Artificial Sequence
  Synthetic nucleic acid molecule
agcagtgtc

SEQ ID NO: 3248 - DNA, 9 bp, Artificial Sequence
  Synthetic nucleic acid molecule
agcagcggc

SEQ ID NO: 3249 - DNA, 9 bp, Artificial Sequence
  Synthetic nucleic acid molecule
agcagcttc

SEQ ID NO: 3250 - DNA, 9 bp, Artificial Sequence
  Synthetic nucleic acid molecule
agcagcttc

SEQ ID NO: 3251 - DNA, 9 bp, Artificial Sequence
  Synthetic nucleic acid molecule
agcagcgac

SEQ ID NO: 3252 - DNA, 9 bp, Artificial Sequence
  Synthetic nucleic acid molecule
agcagcggc

SEQ ID NO: 3253 - DNA, 9 bp, Artificial Sequence
  Synthetic nucleic acid molecule
agcagtgtc

SEQ ID NO: 3254 - DNA, 9 bp, Artificial Sequence
  Synthetic nucleic acid molecule
agcagcggc

SEQ ID NO: 3255 - DNA, 9 bp, Artificial Sequence
  Synthetic nucleic acid molecule
agcagcggc

SEQ ID NO: 3256 - DNA, 9 bp, Artificial Sequence
  Synthetic nucleic acid molecule
agcaacgtc

SEQ ID NO: 3257 - DNA, 9 bp, Artificial Sequence
  Synthetic nucleic acid molecule
agcattgtc

SEQ ID NO: 3258 - DNA, 9 bp, Artificial Sequence
  Synthetic nucleic acid molecule
agcatggtc

SEQ ID NO: 3259 - DNA, 9 bp, Artificial Sequence
  Synthetic nucleic acid molecule
agcaacatc

SEQ ID NO: 3260 - DNA, 9 bp, Artificial Sequence
  Synthetic nucleic acid molecule
agcaatgtc

SEQ ID NO: 3261 - DNA, 9 bp, Artificial Sequence
  Synthetic nucleic acid molecule
agcagctgc

SEQ ID NO: 3262 - DNA, 9 bp, Artificial Sequence
  Synthetic nucleic acid molecule
agctgggtc

SEQ ID NO: 3263 - DNA, 9 bp, Artificial Sequence
  Synthetic nucleic acid molecule
agcagctgc

SEQ ID NO: 3264 - DNA, 9 bp, Artificial Sequence
  Synthetic nucleic acid molecule
agcattgtc

SEQ ID NO: 3265 - DNA, 9 bp, Artificial Sequence
  Synthetic nucleic acid molecule
agcaaagtc

SEQ ID NO: 3266 - DNA, 9 bp, Artificial Sequence
  Synthetic nucleic acid molecule
agcagggtg

SEQ ID NO: 3267 - DNA, 9 bp, Artificial Sequence
  Synthetic nucleic acid molecule
atcaacgtc

SEQ ID NO: 3268 - DNA, 9 bp, Artificial Sequence
  Synthetic nucleic acid molecule
agcagcttt

SEQ ID NO: 3269 - DNA, 9 bp, Artificial Sequence
  Synthetic nucleic acid molecule
ggcagcgtt

SEQ ID NO: 3270 - DNA, 9 bp, Artificial Sequence
  Synthetic nucleic acid molecule
agcaccatc

SEQ ID NO: 3271 - DNA, 9 bp, Artificial Sequence
  Synthetic nucleic acid molecule
atcagagtc

SEQ ID NO: 3272 - DNA, 9 bp, Artificial Sequence
  Synthetic nucleic acid molecule
agcaccggc

SEQ ID NO: 3273 - DNA, 9 bp, Artificial Sequence
  Synthetic nucleic acid molecule
ggcagggtc

SEQ ID NO: 3274 - DNA, 9 bp, Artificial Sequence
  Synthetic nucleic acid molecule
agcaccttc

SEQ ID NO: 3275 - DNA, 9 bp, Artificial Sequence
  Synthetic nucleic acid molecule
agcggtgtc

SEQ ID NO: 3276 - DNA, 9 bp, Artificial Sequence
  Synthetic nucleic acid molecule
agcaatgtc

SEQ ID NO: 3277 - DNA, 9 bp, Artificial Sequence
  Synthetic nucleic acid molecule
agcagggta

SEQ ID NO: 3278 - DNA, 9 bp, Artificial Sequence
  Synthetic nucleic acid molecule
agcaacgtg

SEQ ID NO: 3279 - DNA, 9 bp, Artificial Sequence
  Synthetic nucleic acid molecule
agcagggta

SEQ ID NO: 3280 - DNA, 9 bp, Artificial Sequence
  Synthetic nucleic acid molecule
agcaatgtc

SEQ ID NO: 3281 - DNA, 9 bp, Artificial Sequence
  Synthetic nucleic acid molecule
agcaatgtc

SEQ ID NO: 3282 - DNA, 9 bp, Artificial Sequence
  Synthetic nucleic acid molecule
tgcagagtc

SEQ ID NO: 3283 - DNA, 9 bp, Artificial Sequence
  Synthetic nucleic acid molecule
agcatagtc

SEQ ID NO: 3284 - DNA, 9 bp, Artificial Sequence
  Synthetic nucleic acid molecule
agcagggta

SEQ ID NO: 3285 - DNA, 9 bp, Artificial Sequence
  Synthetic nucleic acid molecule
atcaccgtc

SEQ ID NO: 3286 - DNA, 9 bp, Artificial Sequence
  Synthetic nucleic acid molecule
ggcagcttc

SEQ ID NO: 3287 - DNA, 9 bp, Artificial Sequence
  Synthetic nucleic acid molecule
agctgggtc

SEQ ID NO: 3288 - DNA, 9 bp, Artificial Sequence
  Synthetic nucleic acid molecule
agcaacgta

SEQ ID NO: 3289 - DNA, 9 bp, Artificial Sequence
  Synthetic nucleic acid molecule
agcaaagtc

SEQ ID NO: 3290 - DNA, 9 bp, Artificial Sequence
  Synthetic nucleic acid molecule
ggcagggtc

SEQ ID NO: 3291 - DNA, 9 bp, Artificial Sequence
  Synthetic nucleic acid molecule
tgcagggtc

SEQ ID NO: 3292 - DNA, 9 bp, Artificial Sequence
  Synthetic nucleic acid molecule
agcaaagtc

SEQ ID NO: 3293 - DNA, 9 bp, Artificial Sequence
  Synthetic nucleic acid molecule
ggcagtgtc

SEQ ID NO: 3294 - DNA, 9 bp, Artificial Sequence
  Synthetic nucleic acid molecule
agcagctgc

SEQ ID NO: 3295 - DNA, 9 bp, Artificial Sequence
  Synthetic nucleic acid molecule
agcagcggt

SEQ ID NO: 3296 - DNA, 9 bp, Artificial Sequence
  Synthetic nucleic acid molecule
agcaacatc

SEQ ID NO: 3297 - DNA, 9 bp, Artificial Sequence
  Synthetic nucleic acid molecule
agcagtgtg

SEQ ID NO: 3298 - DNA, 9 bp, Artificial Sequence
  Synthetic nucleic acid molecule
ggcagcttc

SEQ ID NO: 3299 - DNA, 9 bp, Artificial Sequence
  Synthetic nucleic acid molecule
agcagagtt

SEQ ID NO: 3300 - DNA, 9 bp, Artificial Sequence
  Synthetic nucleic acid molecule
agcaccttc

SEQ ID NO: 3301 - DNA, 9 bp, Artificial Sequence
  Synthetic nucleic acid molecule
agcagctgc

SEQ ID NO: 3302 - DNA, 9 bp, Artificial Sequence
  Synthetic nucleic acid molecule
agtagagtc

SEQ ID NO: 3303 - DNA, 9 bp, Artificial Sequence
  Synthetic nucleic acid molecule
agcatggtc

SEQ ID NO: 3304 - DNA, 9 bp, Artificial Sequence
  Synthetic nucleic acid molecule
agcattgtc

SEQ ID NO: 3305 - DNA, 9 bp, Artificial Sequence
  Synthetic nucleic acid molecule
atcagagtc

SEQ ID NO: 3306 - DNA, 9 bp, Artificial Sequence
  Synthetic nucleic acid molecule
agcagctta

SEQ ID NO: 3307 - DNA, 9 bp, Artificial Sequence
  Synthetic nucleic acid molecule
gacagcgtc

SEQ ID NO: 3308 - DNA, 9 bp, Artificial Sequence
  Synthetic nucleic acid molecule
tgcagagtc

SEQ ID NO: 3309 - DNA, 9 bp, Artificial Sequence
  Synthetic nucleic acid molecule
agcagagtt

SEQ ID NO: 3310 - DNA, 9 bp, Artificial Sequence
  Synthetic nucleic acid molecule
agcagggta

SEQ ID NO: 3311 - DNA, 9 bp, Artificial Sequence
  Synthetic nucleic acid molecule
tgcagtgac

SEQ ID NO: 3312 - DNA, 9 bp, Artificial Sequence
  Synthetic nucleic acid molecule
agcagaggt

SEQ ID NO: 3313 - DNA, 9 bp, Artificial Sequence
  Synthetic nucleic acid molecule
agcagttta

SEQ ID NO: 3314 - DNA, 9 bp, Artificial Sequence
  Synthetic nucleic acid molecule
agaaaggtc

SEQ ID NO: 3315 - DNA, 9 bp, Artificial Sequence
  Synthetic nucleic acid molecule
agcacaatc

SEQ ID NO: 3316 - DNA, 9 bp, Artificial Sequence
  Synthetic nucleic acid molecule
agcaaaggc

SEQ ID NO: 3317 - DNA, 9 bp, Artificial Sequence
  Synthetic nucleic acid molecule
agccacatc

SEQ ID NO: 3318 - DNA, 9 bp, Artificial Sequence
  Synthetic nucleic acid molecule
tgctgggtc

SEQ ID NO: 3319 - DNA, 9 bp, Artificial Sequence
  Synthetic nucleic acid molecule
ggcagtgtg

SEQ ID NO: 3320 - DNA, 9 bp, Artificial Sequence
  Synthetic nucleic acid molecule
agtagtgtg

SEQ ID NO: 3321 - DNA, 9 bp, Artificial Sequence
  Synthetic nucleic acid molecule
tgcatggtc

SEQ ID NO: 3322 - DNA, 9 bp, Artificial Sequence
  Synthetic nucleic acid molecule
agcatagtt

SEQ ID NO: 3323 - DNA, 9 bp, Artificial Sequence
  Synthetic nucleic acid molecule
agcagcagg

SEQ ID NO: 3324 - DNA, 9 bp, Artificial Sequence
  Synthetic nucleic acid molecule
agcaccatt

SEQ ID NO: 3325 - DNA, 9 bp, Artificial Sequence
  Synthetic nucleic acid molecule
atcagggtt

SEQ ID NO: 3326 - DNA, 9 bp, Artificial Sequence
  Synthetic nucleic acid molecule
agcaaagtg

SEQ ID NO: 3327 - DNA, 9 bp, Artificial Sequence
  Synthetic nucleic acid molecule
agcaacacc

SEQ ID NO: 3328 - DNA, 9 bp, Artificial Sequence
  Synthetic nucleic acid molecule
ggcagtggc

SEQ ID NO: 3329 - DNA, 9 bp, Artificial Sequence
  Synthetic nucleic acid molecule
agtatcggc

SEQ ID NO: 3330 - DNA, 9 bp, Artificial Sequence
  Synthetic nucleic acid molecule
ggcagctcc

SEQ ID NO: 3331 - DNA, 9 bp, Artificial Sequence
  Synthetic nucleic acid molecule
agcaaaggc

SEQ ID NO: 3332 - DNA, 9 bp, Artificial Sequence
  Synthetic nucleic acid molecule
agcaagttc

SEQ ID NO: 3333 - DNA, 9 bp, Artificial Sequence
  Synthetic nucleic acid molecule
agcaaaggc

SEQ ID NO: 3334 - DNA, 9 bp, Artificial Sequence
  Synthetic nucleic acid molecule
cgcagcaac

SEQ ID NO: 3335 - DNA, 9 bp, Artificial Sequence
  Synthetic nucleic acid molecule
ggcagcggt

SEQ ID NO: 3336 - DNA, 9 bp, Artificial Sequence
  Synthetic nucleic acid molecule
agcaactgc

SEQ ID NO: 3337 - DNA, 9 bp, Artificial Sequence
  Synthetic nucleic acid molecule
agaagagta

SEQ ID NO: 3338 - DNA, 9 bp, Artificial Sequence
  Synthetic nucleic acid molecule
agcaacata

SEQ ID NO: 3339 - DNA, 9 bp, Artificial Sequence
  Synthetic nucleic acid molecule
cgcaccttc

SEQ ID NO: 3340 - DNA, 9 bp, Artificial Sequence
  Synthetic nucleic acid molecule
gtccgcgtc

SEQ ID NO: 3341 - DNA, 9 bp, Artificial Sequence
  Synthetic nucleic acid molecule
ggcagtgtg

SEQ ID NO: 3342 - DNA, 9 bp, Artificial Sequence
  Synthetic nucleic acid molecule
cccaccgtc

SEQ ID NO: 3343 - DNA, 9 bp, Artificial Sequence
  Synthetic nucleic acid molecule
aacaacgtg

SEQ ID NO: 3344 - DNA, 9 bp, Artificial Sequence
  Synthetic nucleic acid molecule
agcaaccac

SEQ ID NO: 3345 - DNA, 9 bp, Artificial Sequence
  Synthetic nucleic acid molecule
agccccttc

SEQ ID NO: 3346 - DNA, 9 bp, Artificial Sequence
  Synthetic nucleic acid molecule
agccgctgc

SEQ ID NO: 3347 - DNA, 9 bp, Artificial Sequence
  Synthetic nucleic acid molecule
agccgctgc

SEQ ID NO: 3348 - DNA, 9 bp, Artificial Sequence
  Synthetic nucleic acid molecule
agccgctgc

SEQ ID NO: 3349 - DNA, 9 bp, Artificial Sequence
  Synthetic nucleic acid molecule
agccgctgc

SEQ ID NO: 3350 - DNA, 9 bp, Artificial Sequence
  Synthetic nucleic acid molecule
agaggggtc

SEQ ID NO: 3351 - DNA, 9 bp, Artificial Sequence
  Synthetic nucleic acid molecule
agcaaaggc

SEQ ID NO: 3352 - DNA, 9 bp, Artificial Sequence
  Synthetic nucleic acid molecule
ggcaacttc

SEQ ID NO: 3353 - DNA, 9 bp, Artificial Sequence
  Synthetic nucleic acid molecule
gccagcttc

SEQ ID NO: 3354 - DNA, 9 bp, Artificial Sequence
  Synthetic nucleic acid molecule
agaagggtg

SEQ ID NO: 3355 - DNA, 9 bp, Artificial Sequence
  Synthetic nucleic acid molecule
agctacgac

SEQ ID NO: 3356 - DNA, 9 bp, Artificial Sequence
  Synthetic nucleic acid molecule
agcaaggtg

SEQ ID NO: 3357 - DNA, 9 bp, Artificial Sequence
  Synthetic nucleic acid molecule
aggagagtt

SEQ ID NO: 3358 - DNA, 9 bp, Artificial Sequence
  Synthetic nucleic acid molecule
tgctccgtc

SEQ ID NO: 3359 - DNA, 9 bp, Artificial Sequence
  Synthetic nucleic acid molecule
agcactgtt

SEQ ID NO: 3360 - DNA, 9 bp, Artificial Sequence
  Synthetic nucleic acid molecule
agtaccatc

SEQ ID NO: 3361 - DNA, 9 bp, Artificial Sequence
  Synthetic nucleic acid molecule
agcagcagg

SEQ ID NO: 3362 - DNA, 9 bp, Artificial Sequence
  Synthetic nucleic acid molecule
ggcagggac

SEQ ID NO: 3363 - DNA, 9 bp, Artificial Sequence
  Synthetic nucleic acid molecule
agcaaggtt

SEQ ID NO: 3364 - DNA, 9 bp, Artificial Sequence
  Synthetic nucleic acid molecule
agcatgggc

SEQ ID NO: 3365 - DNA, 9 bp, Artificial Sequence
  Synthetic nucleic acid molecule
agctgagta

SEQ ID NO: 3366 - DNA, 9 bp, Artificial Sequence
  Synthetic nucleic acid molecule
agcgacttc

SEQ ID NO: 3367 - DNA, 9 bp, Artificial Sequence
  Synthetic nucleic acid molecule
aggagagtt

SEQ ID NO: 3368 - DNA, 9 bp, Artificial Sequence
  Synthetic nucleic acid molecule
gacagcatc

SEQ ID NO: 3369 - DNA, 9 bp, Artificial Sequence
  Synthetic nucleic acid molecule
agcaactcc

SEQ ID NO: 3370 - DNA, 9 bp, Artificial Sequence
  Synthetic nucleic acid molecule
agtcgcttc

SEQ ID NO: 3371 - DNA, 9 bp, Artificial Sequence
  Synthetic nucleic acid molecule
agtaacatc

SEQ ID NO: 3372 - DNA, 9 bp, Artificial Sequence
  Synthetic nucleic acid molecule
agcaactgc

SEQ ID NO: 3373 - DNA, 9 bp, Artificial Sequence
  Synthetic nucleic acid molecule
agcattgtg

SEQ ID NO: 3374 - DNA, 9 bp, Artificial Sequence
  Synthetic nucleic acid molecule
agaaaagtc

SEQ ID NO: 3375 - DNA, 9 bp, Artificial Sequence
  Synthetic nucleic acid molecule
ggcagtgta

SEQ ID NO: 3376 - DNA, 9 bp, Artificial Sequence
  Synthetic nucleic acid molecule
agcaaggta

SEQ ID NO: 3377 - DNA, 9 bp, Artificial Sequence
  Synthetic nucleic acid molecule
agcatctgc

SEQ ID NO: 3378 - DNA, 9 bp, Artificial Sequence
  Synthetic nucleic acid molecule
tgcatagtc

SEQ ID NO: 3379 - DNA, 9 bp, Artificial Sequence
  Synthetic nucleic acid molecule
agaagggtg

SEQ ID NO: 3380 - DNA, 9 bp, Artificial Sequence
  Synthetic nucleic acid molecule
agccgagtg

SEQ ID NO: 3381 - DNA, 9 bp, Artificial Sequence
  Synthetic nucleic acid molecule
ctcagggtc

SEQ ID NO: 3382 - DNA, 9 bp, Artificial Sequence
  Synthetic nucleic acid molecule
aacagggtt

SEQ ID NO: 3383 - DNA, 9 bp, Artificial Sequence
  Synthetic nucleic acid molecule
agcctagtc

SEQ ID NO: 3384 - DNA, 9 bp, Artificial Sequence
  Synthetic nucleic acid molecule
agcaatgtt

SEQ ID NO: 3385 - DNA, 9 bp, Artificial Sequence
  Synthetic nucleic acid molecule
agcagcaaa

SEQ ID NO: 3386 - DNA, 9 bp, Artificial Sequence
  Synthetic nucleic acid molecule
agcagtccc

SEQ ID NO: 3387 - DNA, 9 bp, Artificial Sequence
  Synthetic nucleic acid molecule
tgcaatgtc

SEQ ID NO: 3388 - DNA, 9 bp, Artificial Sequence
  Synthetic nucleic acid molecule
tgcaggttc

SEQ ID NO: 3389 - DNA, 9 bp, Artificial Sequence
  Synthetic nucleic acid molecule
agctaagtc

SEQ ID NO: 3390 - DNA, 9 bp, Artificial Sequence
  Synthetic nucleic acid molecule
agcatagtt

SEQ ID NO: 3391 - DNA, 9 bp, Artificial Sequence
  Synthetic nucleic acid molecule
agcatggta

SEQ ID NO: 3392 - DNA, 9 bp, Artificial Sequence
  Synthetic nucleic acid molecule
agcaaggac

SEQ ID NO: 3393 - DNA, 9 bp, Artificial Sequence
  Synthetic nucleic acid molecule
aggtgggtc

SEQ ID NO: 3394 - DNA, 9 bp, Artificial Sequence
  Synthetic nucleic acid molecule
agcagctgt

SEQ ID NO: 3395 - DNA, 9 bp, Artificial Sequence
  Synthetic nucleic acid molecule
tgcatggtc

SEQ ID NO: 3396 - DNA, 9 bp, Artificial Sequence
  Synthetic nucleic acid molecule
agcatagta

SEQ ID NO: 3397 - DNA, 9 bp, Artificial Sequence
  Synthetic nucleic acid molecule
agcaaggta

SEQ ID NO: 3398 - DNA, 9 bp, Artificial Sequence
  Synthetic nucleic acid molecule
tgcaccttc

SEQ ID NO: 3399 - DNA, 9 bp, Artificial Sequence
  Synthetic nucleic acid molecule
agcaccgag

SEQ ID NO: 3400 - DNA, 9 bp, Artificial Sequence
  Synthetic nucleic acid molecule
tggagagtc

SEQ ID NO: 3401 - DNA, 9 bp, Artificial Sequence
  Synthetic nucleic acid molecule
agaagagtt

SEQ ID NO: 3402 - DNA, 9 bp, Artificial Sequence
  Synthetic nucleic acid molecule
atcagggtt

SEQ ID NO: 3403 - DNA, 9 bp, Artificial Sequence
  Synthetic nucleic acid molecule
ggcagtgcc

SEQ ID NO: 3404 - DNA, 9 bp, Artificial Sequence
  Synthetic nucleic acid molecule
agtaaggtc

SEQ ID NO: 3405 - DNA, 9 bp, Artificial Sequence
  Synthetic nucleic acid molecule
agcagcagg

SEQ ID NO: 3406 - DNA, 9 bp, Artificial Sequence
  Synthetic nucleic acid molecule
agccatgtg

SEQ ID NO: 3407 - DNA, 9 bp, Artificial Sequence
  Synthetic nucleic acid molecule
ggtagtgtt

SEQ ID NO: 3408 - DNA, 9 bp, Artificial Sequence
  Synthetic nucleic acid molecule
tacaaagtc

SEQ ID NO: 3409 - DNA, 9 bp, Artificial Sequence
  Synthetic nucleic acid molecule
agccatgta

SEQ ID NO: 3410 - DNA, 9 bp, Artificial Sequence
  Synthetic nucleic acid molecule
gactgggtc

SEQ ID NO: 3411 - DNA, 9 bp, Artificial Sequence
  Synthetic nucleic acid molecule
agcacagca

SEQ ID NO: 3412 - DNA, 9 bp, Artificial Sequence
  Synthetic nucleic acid molecule
tgaatagtc

SEQ ID NO: 3413 - DNA, 9 bp, Artificial Sequence
  Synthetic nucleic acid molecule
gtcaggttc

SEQ ID NO: 3414 - DNA, 9 bp, Artificial Sequence
  Synthetic nucleic acid molecule
ggtaaagtc

SEQ ID NO: 3415 - DNA, 9 bp, Artificial Sequence
  Synthetic nucleic acid molecule
agtatagtg

SEQ ID NO: 3416 - DNA, 9 bp, Artificial Sequence
  Synthetic nucleic acid molecule
atgggggtc

SEQ ID NO: 3417 - DNA, 9 bp, Artificial Sequence
  Synthetic nucleic acid molecule
cccaaagtc

SEQ ID NO: 3418 - DNA, 9 bp, Artificial Sequence
  Synthetic nucleic acid molecule
caaatcgtc

SEQ ID NO: 3419 - DNA, 9 bp, Artificial Sequence
  Synthetic nucleic acid molecule
aataaggtc

SEQ ID NO: 3420 - DNA, 9 bp, Artificial Sequence
  Synthetic nucleic acid molecule
agtatagtt

SEQ ID NO: 3421 - DNA, 9 bp, Artificial Sequence
  Synthetic nucleic acid molecule
agagaggtc

SEQ ID NO: 3422 - DNA, 9 bp, Artificial Sequence
  Synthetic nucleic acid molecule
tggtgagtc

SEQ ID NO: 3423 - DNA, 9 bp, Artificial Sequence
  Synthetic nucleic acid molecule
tgcctggtc

SEQ ID NO: 3424 - DNA, 9 bp, Artificial Sequence
  Synthetic nucleic acid molecule
agccatgtg

SEQ ID NO: 3425 - DNA, 9 bp, Artificial Sequence
  Synthetic nucleic acid molecule
aacaaggtt

SEQ ID NO: 3426 - DNA, 9 bp, Artificial Sequence
  Synthetic nucleic acid molecule
agcaattta

SEQ ID NO: 3427 - DNA, 9 bp, Artificial Sequence
  Synthetic nucleic acid molecule
aggcatgtc

SEQ ID NO: 3428 - DNA, 9 bp, Artificial Sequence
  Synthetic nucleic acid molecule
tacaaagtc

SEQ ID NO: 3429 - DNA, 9 bp, Artificial Sequence
  Synthetic nucleic acid molecule
aataaggtc

SEQ ID NO: 3430 - DNA, 9 bp, Artificial Sequence
  Synthetic nucleic acid molecule
aataaagtc

SEQ ID NO: 3431 - DNA, 9 bp, Artificial Sequence
  Synthetic nucleic acid molecule
aataaggtc

SEQ ID NO: 3432 - DNA, 9 bp, Artificial Sequence
  Synthetic nucleic acid molecule
aataaggtc

SEQ ID NO: 3433 - DNA, 9 bp, Artificial Sequence
  Synthetic nucleic acid molecule
aataaggtc

SEQ ID NO: 3434 - DNA, 9 bp, Artificial Sequence
  Synthetic nucleic acid molecule
aataaggtc

SEQ ID NO: 3435 - DNA, 9 bp, Artificial Sequence
  Synthetic nucleic acid molecule
agcacagca

SEQ ID NO: 3436 - DNA, 9 bp, Artificial Sequence
  Synthetic nucleic acid molecule
ggaaaggtc

SEQ ID NO: 3437 - DNA, 9 bp, Artificial Sequence
  Synthetic nucleic acid molecule
agccatttc

SEQ ID NO: 3438 - DNA, 9 bp, Artificial Sequence
  Synthetic nucleic acid molecule
aataaggtc

SEQ ID NO: 3439 - DNA, 9 bp, Artificial Sequence
  Synthetic nucleic acid molecule
atcagcact

SEQ ID NO: 3440 - DNA, 9 bp, Artificial Sequence
  Synthetic nucleic acid molecule
ggtggggtc

SEQ ID NO: 3441 - DNA, 9 bp, Artificial Sequence
  Synthetic nucleic acid molecule
cacacagtc

SEQ ID NO: 3442 - DNA, 9 bp, Artificial Sequence
  Synthetic nucleic acid molecule
aatattgtc

SEQ ID NO: 3443 - DNA, 9 bp, Artificial Sequence
  Synthetic nucleic acid molecule
ggaatagtc

SEQ ID NO: 3444 - DNA, 9 bp, Artificial Sequence
  Synthetic nucleic acid molecule
agcaacaat

SEQ ID NO: 3445 - DNA, 9 bp, Artificial Sequence
  Synthetic nucleic acid molecule
aataaggtc

SEQ ID NO: 3446 - DNA, 9 bp, Artificial Sequence
  Synthetic nucleic acid molecule
gactgtgtc

SEQ ID NO: 3447 - DNA, 9 bp, Artificial Sequence
  Synthetic nucleic acid molecule
aataaagtc

SEQ ID NO: 3448 - DNA, 9 bp, Artificial Sequence
  Synthetic nucleic acid molecule
aataaggtc

SEQ ID NO: 3449 - DNA, 9 bp, Artificial Sequence
  Synthetic nucleic acid molecule
aataaggtc

SEQ ID NO: 3450 - DNA, 9 bp, Artificial Sequence
  Synthetic nucleic acid molecule
aataaggtc

SEQ ID NO: 3451 - DNA, 9 bp, Artificial Sequence
  Synthetic nucleic acid molecule
aataaggtc

SEQ ID NO: 3452 - DNA, 9 bp, Artificial Sequence
  Synthetic nucleic acid molecule
agcagcttc

SEQ ID NO: 3453 - DNA, 9 bp, Artificial Sequence
  Synthetic nucleic acid molecule
ggcaacgtc

SEQ ID NO: 3454 - DNA, 9 bp, Artificial Sequence
  Synthetic nucleic acid molecule
agcagtttc

SEQ ID NO: 3455 - DNA, 9 bp, Artificial Sequence
  Synthetic nucleic acid molecule
agcagtttc

SEQ ID NO: 3456 - DNA, 9 bp, Artificial Sequence
  Synthetic nucleic acid molecule
agcagcagc

SEQ ID NO: 3457 - DNA, 9 bp, Artificial Sequence
  Synthetic nucleic acid molecule
agcagcagc

SEQ ID NO: 3458 - DNA, 9 bp, Artificial Sequence
  Synthetic nucleic acid molecule
agcaacttc

SEQ ID NO: 3459 - DNA, 9 bp, Artificial Sequence
  Synthetic nucleic acid molecule
agcaacttc

SEQ ID NO: 3460 - DNA, 9 bp, Artificial Sequence
  Synthetic nucleic acid molecule
agcaaggtc

SEQ ID NO: 3461 - DNA, 9 bp, Artificial Sequence
  Synthetic nucleic acid molecule
agcagtttc

SEQ ID NO: 3462 - DNA, 9 bp, Artificial Sequence
  Synthetic nucleic acid molecule
agcagcagc

SEQ ID NO: 3463 - DNA, 9 bp, Artificial Sequence
  Synthetic nucleic acid molecule
agcattgtc

SEQ ID NO: 3464 - DNA, 9 bp, Artificial Sequence
  Synthetic nucleic acid molecule
agcccagtc

SEQ ID NO: 3465 - DNA, 9 bp, Artificial Sequence
  Synthetic nucleic acid molecule
agctacatc

SEQ ID NO: 3466 - DNA, 9 bp, Artificial Sequence
  Synthetic nucleic acid molecule
agcatggtt

SEQ ID NO: 3467 - DNA, 9 bp, Artificial Sequence
  Synthetic nucleic acid molecule
gacagggtc

SEQ ID NO: 3468 - DNA, 9 bp, Artificial Sequence
  Synthetic nucleic acid molecule
atcctcgtc

SEQ ID NO: 3469 - DNA, 9 bp, Artificial Sequence
  Synthetic nucleic acid molecule
cagagcgtc

SEQ ID NO: 3470 - DNA, 9 bp, Artificial Sequence
  Synthetic nucleic acid molecule
agcaaaggc

SEQ ID NO: 3471 - DNA, 9 bp, Artificial Sequence
  Synthetic nucleic acid molecule
agcatcgat

SEQ ID NO: 3472 - DNA, 9 bp, Artificial Sequence
  Synthetic nucleic acid molecule
atcatggtc

SEQ ID NO: 3473 - DNA, 9 bp, Artificial Sequence
  Synthetic nucleic acid molecule
agcccagtc

SEQ ID NO: 3474 - DNA, 9 bp, Artificial Sequence
  Synthetic nucleic acid molecule
tgcatagtc

SEQ ID NO: 3475 - DNA, 9 bp, Artificial Sequence
  Synthetic nucleic acid molecule
agccatgtc

SEQ ID NO: 3476 - DNA, 9 bp, Artificial Sequence
  Synthetic nucleic acid molecule
agcattgta

SEQ ID NO: 3477 - DNA, 9 bp, Artificial Sequence
  Synthetic nucleic acid molecule
atcatggtc

SEQ ID NO: 3478 - DNA, 9 bp, Artificial Sequence
  Synthetic nucleic acid molecule
agcaaaggc

SEQ ID NO: 3479 - DNA, 9 bp, Artificial Sequence
  Synthetic nucleic acid molecule
ataagagtc

SEQ ID NO: 3480 - DNA, 9 bp, Artificial Sequence
  Synthetic nucleic acid molecule
agccatgtc

SEQ ID NO: 3481 - DNA, 9 bp, Artificial Sequence
  Synthetic nucleic acid molecule
agcaaaggc

SEQ ID NO: 3482 - DNA, 9 bp, Artificial Sequence
  Synthetic nucleic acid molecule
agcccagtc

SEQ ID NO: 3483 - DNA, 9 bp, Artificial Sequence
  Synthetic nucleic acid molecule
ttccacgtc

SEQ ID NO: 3484 - DNA, 9 bp, Artificial Sequence
  Synthetic nucleic acid molecule
agtcaggtc

SEQ ID NO: 3485 - DNA, 9 bp, Artificial Sequence
  Synthetic nucleic acid molecule
ctgagggtc

SEQ ID NO: 3486 - DNA, 9 bp, Artificial Sequence
  Synthetic nucleic acid molecule
atgacagtc

SEQ ID NO: 3487 - DNA, 9 bp, Artificial Sequence
  Synthetic nucleic acid molecule
aacagtcta

SEQ ID NO: 3488 - DNA, 9 bp, Artificial Sequence
  Synthetic nucleic acid molecule
ctcagtttc

SEQ ID NO: 3489 - DNA, 9 bp, Artificial Sequence
  Synthetic nucleic acid molecule
agtcaggtc

SEQ ID NO: 3490 - DNA, 9 bp, Artificial Sequence
  Synthetic nucleic acid molecule
gtgggcgtc

SEQ ID NO: 3491 - DNA, 9 bp, Artificial Sequence
  Synthetic nucleic acid molecule
ggtggggtc

SEQ ID NO: 3492 - DNA, 9 bp, Artificial Sequence
  Synthetic nucleic acid molecule
agttaagtc

SEQ ID NO: 3493 - DNA, 9 bp, Artificial Sequence
  Synthetic nucleic acid molecule
ttcaccttc

SEQ ID NO: 3494 - DNA, 9 bp, Artificial Sequence
  Synthetic nucleic acid molecule
tcctgagtc

SEQ ID NO: 3495 - DNA, 9 bp, Artificial Sequence
  Synthetic nucleic acid molecule
ataatagtc

SEQ ID NO: 3496 - DNA, 9 bp, Artificial Sequence
  Synthetic nucleic acid molecule
agcaaaggt

SEQ ID NO: 3497 - DNA, 9 bp, Artificial Sequence
  Synthetic nucleic acid molecule
agtttagtc

SEQ ID NO: 3498 - DNA, 9 bp, Artificial Sequence
  Synthetic nucleic acid molecule
acaaaggtc

SEQ ID NO: 3499 - DNA, 9 bp, Artificial Sequence
  Synthetic nucleic acid molecule
tgcagtccc

SEQ ID NO: 3500 - DNA, 9 bp, Artificial Sequence
  Synthetic nucleic acid molecule
agtcatgtc

SEQ ID NO: 3501 - DNA, 9 bp, Artificial Sequence
  Synthetic nucleic acid molecule
caccacgtc

SEQ ID NO: 3502 - DNA, 9 bp, Artificial Sequence
  Synthetic nucleic acid molecule
ctcagtttc

SEQ ID NO: 3503 - DNA, 9 bp, Artificial Sequence
  Synthetic nucleic acid molecule
gaaagtgtc

SEQ ID NO: 3504 - DNA, 9 bp, Artificial Sequence
  Synthetic nucleic acid molecule
gggtgggtc

SEQ ID NO: 3505 - DNA, 9 bp, Artificial Sequence
  Synthetic nucleic acid molecule
agagttgtc

SEQ ID NO: 3506 - DNA, 9 bp, Artificial Sequence
  Synthetic nucleic acid molecule
agaaggggt

SEQ ID NO: 3507 - DNA, 9 bp, Artificial Sequence
  Synthetic nucleic acid molecule
agcagagtc

SEQ ID NO: 3508 - DNA, 9 bp, Artificial Sequence
  Synthetic nucleic acid molecule
accatcttc

SEQ ID NO: 3509 - DNA, 9 bp, Artificial Sequence
  Synthetic nucleic acid molecule
aggaacgtc

SEQ ID NO: 3510 - DNA, 9 bp, Artificial Sequence
  Synthetic nucleic acid molecule
agcaccttc

SEQ ID NO: 3511 - DNA, 9 bp, Artificial Sequence
  Synthetic nucleic acid molecule
ggcagggtc

SEQ ID NO: 3512 - DNA, 9 bp, Artificial Sequence
  Synthetic nucleic acid molecule
ggcagggtc

SEQ ID NO: 3513 - DNA, 9 bp, Artificial Sequence
  Synthetic nucleic acid molecule
agcacagtc

SEQ ID NO: 3514 - DNA, 9 bp, Artificial Sequence
  Synthetic nucleic acid molecule
ggcagggtc

SEQ ID NO: 3515 - DNA, 9 bp, Artificial Sequence
  Synthetic nucleic acid molecule
agcaaggtc

SEQ ID NO: 3516 - DNA, 9 bp, Artificial Sequence
  Synthetic nucleic acid molecule
agcaagttc

SEQ ID NO: 3517 - DNA, 9 bp, Artificial Sequence
  Synthetic nucleic acid molecule
agcagtttt

SEQ ID NO: 3518 - DNA, 9 bp, Artificial Sequence
  Synthetic nucleic acid molecule
agctgcgtc

SEQ ID NO: 3519 - DNA, 9 bp, Artificial Sequence
  Synthetic nucleic acid molecule
agcagggtc

SEQ ID NO: 3520 - DNA, 9 bp, Artificial Sequence
  Synthetic nucleic acid molecule
agcagggtc

SEQ ID NO: 3521 - DNA, 9 bp, Artificial Sequence
  Synthetic nucleic acid molecule
agaagcctc

SEQ ID NO: 3522 - DNA, 9 bp, Artificial Sequence
  Synthetic nucleic acid molecule
agaagcctc

SEQ ID NO: 3523 - DNA, 9 bp, Artificial Sequence
  Synthetic nucleic acid molecule
agcattttc

SEQ ID NO: 3524 - DNA, 9 bp, Artificial Sequence
  Synthetic nucleic acid molecule
agcagcgtc

SEQ ID NO: 3525 - DNA, 9 bp, Artificial Sequence
  Synthetic nucleic acid molecule
agcagtgtc

SEQ ID NO: 3526 - DNA, 9 bp, Artificial Sequence
  Synthetic nucleic acid molecule
agcagtgtc

SEQ ID NO: 3527 - DNA, 9 bp, Artificial Sequence
  Synthetic nucleic acid molecule
agcaacttc

SEQ ID NO: 3528 - DNA, 9 bp, Artificial Sequence
  Synthetic nucleic acid molecule
agcccggtc

SEQ ID NO: 3529 - DNA, 9 bp, Artificial Sequence
  Synthetic nucleic acid molecule
agtaacttc

SEQ ID NO: 3530 - DNA, 9 bp, Artificial Sequence
  Synthetic nucleic acid molecule
agtaacttc

SEQ ID NO: 3531 - DNA, 9 bp, Artificial Sequence
  Synthetic nucleic acid molecule
acctgcttc

SEQ ID NO: 3532 - DNA, 9 bp, Artificial Sequence
  Synthetic nucleic acid molecule
agcattttc

SEQ ID NO: 3533 - DNA, 9 bp, Artificial Sequence
  Synthetic nucleic acid molecule
agtaacttc

SEQ ID NO: 3534 - DNA, 9 bp, Artificial Sequence
  Synthetic nucleic acid molecule
agcaatgtt

SEQ ID NO: 3535 - DNA, 9 bp, Artificial Sequence
  Synthetic nucleic acid molecule
agcattttc

SEQ ID NO: 3536 - DNA, 9 bp, Artificial Sequence
  Synthetic nucleic acid molecule
agccacggc

SEQ ID NO: 3537 - DNA, 9 bp, Artificial Sequence
  Synthetic nucleic acid molecule
cctagagtc

SEQ ID NO: 3538 - DNA, 9 bp, Artificial Sequence
  Synthetic nucleic acid molecule
atcatagtg

SEQ ID NO: 3539 - DNA, 9 bp, Artificial Sequence
  Synthetic nucleic acid molecule
gagtgagaa

SEQ ID NO: 3540 - DNA, 9 bp, Artificial Sequence
  Synthetic nucleic acid molecule
cagtgagga

SEQ ID NO: 3541 - DNA, 9 bp, Artificial Sequence
  Synthetic nucleic acid molecule
gattgagga

SEQ ID NO: 3542 - DNA, 9 bp, Artificial Sequence
  Synthetic nucleic acid molecule
gagtgagga

SEQ ID NO: 3543 - DNA, 9 bp, Artificial Sequence
  Synthetic nucleic acid molecule
gagtgagga

SEQ ID NO: 3544 - DNA, 9 bp, Artificial Sequence
  Synthetic nucleic acid molecule
gagtgagga

SEQ ID NO: 3545 - DNA, 9 bp, Artificial Sequence
  Synthetic nucleic acid molecule
gagtgagga

SEQ ID NO: 3546 - DNA, 9 bp, Artificial Sequence
  Synthetic nucleic acid molecule
gagtgagga

SEQ ID NO: 3547 - DNA, 9 bp, Artificial Sequence
  Synthetic nucleic acid molecule
gagtgagga

SEQ ID NO: 3548 - DNA, 9 bp, Artificial Sequence
  Synthetic nucleic acid molecule
gagtgagga

SEQ ID NO: 3549 - DNA, 9 bp, Artificial Sequence
  Synthetic nucleic acid molecule
gagtgagga

SEQ ID NO: 3550 - DNA, 9 bp, Artificial Sequence
  Synthetic nucleic acid molecule
gagtgagga

SEQ ID NO: 3551 - DNA, 9 bp, Artificial Sequence
  Synthetic nucleic acid molecule
gagtgagga

SEQ ID NO: 3552 - DNA, 9 bp, Artificial Sequence
  Synthetic nucleic acid molecule
gagtgagga

SEQ ID NO: 3553 - DNA, 9 bp, Artificial Sequence
  Synthetic nucleic acid molecule
gagtgagga

SEQ ID NO: 3554 - DNA, 9 bp, Artificial Sequence
  Synthetic nucleic acid molecule
gagtgagga

SEQ ID NO: 3555 - DNA, 9 bp, Artificial Sequence
  Synthetic nucleic acid molecule
gagtgagga

SEQ ID NO: 3556 - DNA, 9 bp, Artificial Sequence
  Synthetic nucleic acid molecule
gagtgagga

SEQ ID NO: 3557 - DNA, 9 bp, Artificial Sequence
  Synthetic nucleic acid molecule
gagtgagga

SEQ ID NO: 3558 - DNA, 9 bp, Artificial Sequence
  Synthetic nucleic acid molecule
gagtgagga

SEQ ID NO: 3559 - DNA, 9 bp, Artificial Sequence
  Synthetic nucleic acid molecule
gagtgagga

SEQ ID NO: 3560 - DNA, 9 bp, Artificial Sequence
  Synthetic nucleic acid molecule
gagtgagga

SEQ ID NO: 3561 - DNA, 9 bp, Artificial Sequence
  Synthetic nucleic acid molecule
gagtgagga

SEQ ID NO: 3562 - DNA, 9 bp, Artificial Sequence
  Synthetic nucleic acid molecule
gagtgagga

SEQ ID NO: 3563 - DNA, 9 bp, Artificial Sequence
  Synthetic nucleic acid molecule
gagtgagga

SEQ ID NO: 3564 - DNA, 9 bp, Artificial Sequence
  Synthetic nucleic acid molecule
gagtgagga

SEQ ID NO: 3565 - DNA, 9 bp, Artificial Sequence
  Synthetic nucleic acid molecule
gagtgagga

SEQ ID NO: 3566 - DNA, 9 bp, Artificial Sequence
  Synthetic nucleic acid molecule
gagtgagga

SEQ ID NO: 3567 - DNA, 9 bp, Artificial Sequence
  Synthetic nucleic acid molecule
gagtgagga

SEQ ID NO: 3568 - DNA, 9 bp, Artificial Sequence
  Synthetic nucleic acid molecule
gggtgaggt

SEQ ID NO: 3569 - DNA, 9 bp, Artificial Sequence
  Synthetic nucleic acid molecule
gagtgttga

SEQ ID NO: 3570 - DNA, 9 bp, Artificial Sequence
  Synthetic nucleic acid molecule
cagtgaggc

SEQ ID NO: 3571 - DNA, 9 bp, Artificial Sequence
  Synthetic nucleic acid molecule
cagtgaggc

SEQ ID NO: 3572 - DNA, 9 bp, Artificial Sequence
  Synthetic nucleic acid molecule
gagtgagat

SEQ ID NO: 3573 - DNA, 9 bp, Artificial Sequence
  Synthetic nucleic acid molecule
gtgtgagaa

SEQ ID NO: 3574 - DNA, 9 bp, Artificial Sequence
  Synthetic nucleic acid molecule
gagtgaggg

SEQ ID NO: 3575 - DNA, 9 bp, Artificial Sequence
  Synthetic nucleic acid molecule
gagtgaggc

SEQ ID NO: 3576 - DNA, 9 bp, Artificial Sequence
  Synthetic nucleic acid molecule
gagtgaggg

SEQ ID NO: 3577 - DNA, 9 bp, Artificial Sequence
  Synthetic nucleic acid molecule
gagtgaggc

SEQ ID NO: 3578 - DNA, 9 bp, Artificial Sequence
  Synthetic nucleic acid molecule
gagtgaggc

SEQ ID NO: 3579 - DNA, 9 bp, Artificial Sequence
  Synthetic nucleic acid molecule
gagtgaggg

SEQ ID NO: 3580 - DNA, 9 bp, Artificial Sequence
  Synthetic nucleic acid molecule
gagtgaggc

SEQ ID NO: 3581 - DNA, 9 bp, Artificial Sequence
  Synthetic nucleic acid molecule
gagtgaggg

SEQ ID NO: 3582 - DNA, 9 bp, Artificial Sequence
  Synthetic nucleic acid molecule
gagtgaggg

SEQ ID NO: 3583 - DNA, 9 bp, Artificial Sequence
  Synthetic nucleic acid molecule
gagtgaggt

SEQ ID NO: 3584 - DNA, 9 bp, Artificial Sequence
  Synthetic nucleic acid molecule
gagtgaggt

SEQ ID NO: 3585 - DNA, 9 bp, Artificial Sequence
  Synthetic nucleic acid molecule
gagtgaggg

SEQ ID NO: 3586 - DNA, 9 bp, Artificial Sequence
  Synthetic nucleic acid molecule
gagtgaggg

SEQ ID NO: 3587 - DNA, 9 bp, Artificial Sequence
  Synthetic nucleic acid molecule
gagtgaggc

SEQ ID NO: 3588 - DNA, 9 bp, Artificial Sequence
  Synthetic nucleic acid molecule
gagtgaggc

SEQ ID NO: 3589 - DNA, 9 bp, Artificial Sequence
  Synthetic nucleic acid molecule
gagtgaggg

SEQ ID NO: 3590 - DNA, 9 bp, Artificial Sequence
  Synthetic nucleic acid molecule
gagtgaggg

SEQ ID NO: 3591 - DNA, 9 bp, Artificial Sequence
  Synthetic nucleic acid molecule
gagtgaggg

SEQ ID NO: 3592 - DNA, 9 bp, Artificial Sequence
  Synthetic nucleic acid molecule
gagtgaggt

SEQ ID NO: 3593 - DNA, 9 bp, Artificial Sequence
  Synthetic nucleic acid molecule
gagtgaggc

SEQ ID NO: 3594 - DNA, 9 bp, Artificial Sequence
  Synthetic nucleic acid molecule
gagtgaggt

SEQ ID NO: 3595 - DNA, 9 bp, Artificial Sequence
  Synthetic nucleic acid molecule
gagtgaggc

SEQ ID NO: 3596 - DNA, 9 bp, Artificial Sequence
  Synthetic nucleic acid molecule
gagtgaggc

SEQ ID NO: 3597 - DNA, 9 bp, Artificial Sequence
  Synthetic nucleic acid molecule
gagtgagga

SEQ ID NO: 3598 - DNA, 9 bp, Artificial Sequence
  Synthetic nucleic acid molecule
gagtgagga

SEQ ID NO: 3599 - DNA, 9 bp, Artificial Sequence
  Synthetic nucleic acid molecule
gagtgagga

SEQ ID NO: 3600 - DNA, 9 bp, Artificial Sequence
  Synthetic nucleic acid molecule
gagtgaggt

SEQ ID NO: 3601 - DNA, 9 bp, Artificial Sequence
  Synthetic nucleic acid molecule
cagagagga

SEQ ID NO: 3602 - DNA, 9 bp, Artificial Sequence
  Synthetic nucleic acid molecule
gagtgagca

SEQ ID NO: 3603 - DNA, 9 bp, Artificial Sequence
  Synthetic nucleic acid molecule
gagtgagaa

SEQ ID NO: 3604 - DNA, 9 bp, Artificial Sequence
  Synthetic nucleic acid molecule
gagagagga

SEQ ID NO: 3605 - DNA, 9 bp, Artificial Sequence
  Synthetic nucleic acid molecule
gagtgagta

SEQ ID NO: 3606 - DNA, 9 bp, Artificial Sequence
  Synthetic nucleic acid molecule
cagtgagga

SEQ ID NO: 3607 - DNA, 9 bp, Artificial Sequence
  Synthetic nucleic acid molecule
aagtgagga

SEQ ID NO: 3608 - DNA, 9 bp, Artificial Sequence
  Synthetic nucleic acid molecule
gagtgagca

SEQ ID NO: 3609 - DNA, 9 bp, Artificial Sequence
  Synthetic nucleic acid molecule
gagtgagta

SEQ ID NO: 3610 - DNA, 9 bp, Artificial Sequence
  Synthetic nucleic acid molecule
gagtgggga

SEQ ID NO: 3611 - DNA, 9 bp, Artificial Sequence
  Synthetic nucleic acid molecule
gaatgagga

SEQ ID NO: 3612 - DNA, 9 bp, Artificial Sequence
  Synthetic nucleic acid molecule
aagtgagga

SEQ ID NO: 3613 - DNA, 9 bp, Artificial Sequence
  Synthetic nucleic acid molecule
aagtgagga

SEQ ID NO: 3614 - DNA, 9 bp, Artificial Sequence
  Synthetic nucleic acid molecule
gagtgatga

SEQ ID NO: 3615 - DNA, 9 bp, Artificial Sequence
  Synthetic nucleic acid molecule
gagtgagca

SEQ ID NO: 3616 - DNA, 9 bp, Artificial Sequence
  Synthetic nucleic acid molecule
gagtgagga

SEQ ID NO: 3617 - DNA, 9 bp, Artificial Sequence
  Synthetic nucleic acid molecule
gagtgagga

SEQ ID NO: 3618 - DNA, 9 bp, Artificial Sequence
  Synthetic nucleic acid molecule
gagtgagga

SEQ ID NO: 3619 - DNA, 9 bp, Artificial Sequence
  Synthetic nucleic acid molecule
gagtgagga

SEQ ID NO: 3620 - DNA, 9 bp, Artificial Sequence
  Synthetic nucleic acid molecule
gagtgagga

SEQ ID NO: 3621 - DNA, 9 bp, Artificial Sequence
  Synthetic nucleic acid molecule
gagtgagga

SEQ ID NO: 3622 - DNA, 9 bp, Artificial Sequence
  Synthetic nucleic acid molecule
gagtgagga

SEQ ID NO: 3623 - DNA, 9 bp, Artificial Sequence
  Synthetic nucleic acid molecule
gagtgagga

SEQ ID NO: 3624 - DNA, 9 bp, Artificial Sequence
  Synthetic nucleic acid molecule
gagtgagga

SEQ ID NO: 3625 - DNA, 9 bp, Artificial Sequence
  Synthetic nucleic acid molecule
gagtgagga

SEQ ID NO: 3626 - DNA, 9 bp, Artificial Sequence
  Synthetic nucleic acid molecule
tagggaggg

SEQ ID NO: 3627 - DNA, 9 bp, Artificial Sequence
  Synthetic nucleic acid molecule
atgtgaggc

SEQ ID NO: 3628 - DNA, 9 bp, Artificial Sequence
  Synthetic nucleic acid molecule
gtgtggggc

SEQ ID NO: 3629 - DNA, 9 bp, Artificial Sequence
  Synthetic nucleic acid molecule
gaggggggt

SEQ ID NO: 3630 - DNA, 9 bp, Artificial Sequence
  Synthetic nucleic acid molecule
gtgtggggc

SEQ ID NO: 3631 - DNA, 9 bp, Artificial Sequence
  Synthetic nucleic acid molecule
tagagaggt

SEQ ID NO: 3632 - DNA, 9 bp, Artificial Sequence
  Synthetic nucleic acid molecule
gagtgtgaa

SEQ ID NO: 3633 - DNA, 9 bp, Artificial Sequence
  Synthetic nucleic acid molecule
cagtgaggg

SEQ ID NO: 3634 - DNA, 9 bp, Artificial Sequence
  Synthetic nucleic acid molecule
gagtggggg

SEQ ID NO: 3635 - DNA, 9 bp, Artificial Sequence
  Synthetic nucleic acid molecule
cagtgaggc

SEQ ID NO: 3636 - DNA, 9 bp, Artificial Sequence
  Synthetic nucleic acid molecule
gagtggggg

SEQ ID NO: 3637 - DNA, 9 bp, Artificial Sequence
  Synthetic nucleic acid molecule
gagtgaagg

SEQ ID NO: 3638 - DNA, 9 bp, Artificial Sequence
  Synthetic nucleic acid molecule
gagttaggt

SEQ ID NO: 3639 - DNA, 9 bp, Artificial Sequence
  Synthetic nucleic acid molecule
cagtgaggc

SEQ ID NO: 3640 - DNA, 9 bp, Artificial Sequence
  Synthetic nucleic acid molecule
gagggaggc

SEQ ID NO: 3641 - DNA, 9 bp, Artificial Sequence
  Synthetic nucleic acid molecule
gagtgagac

SEQ ID NO: 3642 - DNA, 9 bp, Artificial Sequence
  Synthetic nucleic acid molecule
gtgtgaggc

SEQ ID NO: 3643 - DNA, 9 bp, Artificial Sequence
  Synthetic nucleic acid molecule
gagggaggg

SEQ ID NO: 3644 - DNA, 9 bp, Artificial Sequence
  Synthetic nucleic acid molecule
gagagaggt

SEQ ID NO: 3645 - DNA, 9 bp, Artificial Sequence
  Synthetic nucleic acid molecule
gagttaggt

SEQ ID NO: 3646 - DNA, 9 bp, Artificial Sequence
  Synthetic nucleic acid molecule
gagtggggg

SEQ ID NO: 3647 - DNA, 9 bp, Artificial Sequence
  Synthetic nucleic acid molecule
gagggaggt

SEQ ID NO: 3648 - DNA, 9 bp, Artificial Sequence
  Synthetic nucleic acid molecule
gagggaggg

SEQ ID NO: 3649 - DNA, 9 bp, Artificial Sequence
  Synthetic nucleic acid molecule
gagggaggg

SEQ ID NO: 3650 - DNA, 9 bp, Artificial Sequence
  Synthetic nucleic acid molecule
gagggaggt

SEQ ID NO: 3651 - DNA, 9 bp, Artificial Sequence
  Synthetic nucleic acid molecule
gagtgggca

SEQ ID NO: 3652 - DNA, 9 bp, Artificial Sequence
  Synthetic nucleic acid molecule
tagtgagga

SEQ ID NO: 3653 - DNA, 9 bp, Artificial Sequence
  Synthetic nucleic acid molecule
gagtgaggt

SEQ ID NO: 3654 - DNA, 9 bp, Artificial Sequence
  Synthetic nucleic acid molecule
gagtgaggc

SEQ ID NO: 3655 - DNA, 9 bp, Artificial Sequence
  Synthetic nucleic acid molecule
gagtgaggg

SEQ ID NO: 3656 - DNA, 9 bp, Artificial Sequence
  Synthetic nucleic acid molecule
gagtgaggg

SEQ ID NO: 3657 - DNA, 9 bp, Artificial Sequence
  Synthetic nucleic acid molecule
gagtgaggg

SEQ ID NO: 3658 - DNA, 9 bp, Artificial Sequence
  Synthetic nucleic acid molecule
gagtgaggg

SEQ ID NO: 3659 - DNA, 9 bp, Artificial Sequence
  Synthetic nucleic acid molecule
gagtgaggg

SEQ ID NO: 3660 - DNA, 9 bp, Artificial Sequence
  Synthetic nucleic acid molecule
gagtgaggc

SEQ ID NO: 3661 - DNA, 9 bp, Artificial Sequence
  Synthetic nucleic acid molecule
gagtgaggg

SEQ ID NO: 3662 - DNA, 9 bp, Artificial Sequence
  Synthetic nucleic acid molecule
gagtgaggt

SEQ ID NO: 3663 - DNA, 9 bp, Artificial Sequence
  Synthetic nucleic acid molecule
gagtgaggg

SEQ ID NO: 3664 - DNA, 9 bp, Artificial Sequence
  Synthetic nucleic acid molecule
gagtgaggt

SEQ ID NO: 3665 - DNA, 9 bp, Artificial Sequence
  Synthetic nucleic acid molecule
gagtaagga

SEQ ID NO: 3666 - DNA, 9 bp, Artificial Sequence
  Synthetic nucleic acid molecule
gagtgaggc

SEQ ID NO: 3667 - DNA, 9 bp, Artificial Sequence
  Synthetic nucleic acid molecule
gagtgaggt

SEQ ID NO: 3668 - DNA, 9 bp, Artificial Sequence
  Synthetic nucleic acid molecule
gagtgaggt

SEQ ID NO: 3669 - DNA, 9 bp, Artificial Sequence
  Synthetic nucleic acid molecule
gagtgaggt

SEQ ID NO: 3670 - DNA, 9 bp, Artificial Sequence
  Synthetic nucleic acid molecule
gagtgaggt

SEQ ID NO: 3671 - DNA, 9 bp, Artificial Sequence
  Synthetic nucleic acid molecule
tagtgagga

SEQ ID NO: 3672 - DNA, 9 bp, Artificial Sequence
  Synthetic nucleic acid molecule
cagtgagga

SEQ ID NO: 3673 - DNA, 9 bp, Artificial Sequence
  Synthetic nucleic acid molecule
cagtgagga

SEQ ID NO: 3674 - DNA, 9 bp, Artificial Sequence
  Synthetic nucleic acid molecule
gagtgaggt

SEQ ID NO: 3675 - DNA, 9 bp, Artificial Sequence
  Synthetic nucleic acid molecule
gagtgaggt

SEQ ID NO: 3676 - DNA, 9 bp, Artificial Sequence
  Synthetic nucleic acid molecule
gagtgaggt

SEQ ID NO: 3677 - DNA, 9 bp, Artificial Sequence
  Synthetic nucleic acid molecule
gagtgagga

SEQ ID NO: 3678 - DNA, 9 bp, Artificial Sequence
  Synthetic nucleic acid molecule
gagtgagga

SEQ ID NO: 3679 - DNA, 9 bp, Artificial Sequence
  Synthetic nucleic acid molecule
gagtgagga

SEQ ID NO: 3680 - DNA, 9 bp, Artificial Sequence
  Synthetic nucleic acid molecule
gagtgagga

SEQ ID NO: 3681 - DNA, 9 bp, Artificial Sequence
  Synthetic nucleic acid molecule
gagtgagga

SEQ ID NO: 3682 - DNA, 9 bp, Artificial Sequence
  Synthetic nucleic acid molecule
gagtgagga

SEQ ID NO: 3683 - DNA, 9 bp, Artificial Sequence
  Synthetic nucleic acid molecule
gagtgagga

SEQ ID NO: 3684 - DNA, 9 bp, Artificial Sequence
  Synthetic nucleic acid molecule
gagtgagga

SEQ ID NO: 3685 - DNA, 9 bp, Artificial Sequence
  Synthetic nucleic acid molecule
gagtgagga

SEQ ID NO: 3686 - DNA, 9 bp, Artificial Sequence
  Synthetic nucleic acid molecule
gagtgagga

SEQ ID NO: 3687 - DNA, 9 bp, Artificial Sequence
  Synthetic nucleic acid molecule
gagtgagga

SEQ ID NO: 3688 - DNA, 9 bp, Artificial Sequence
  Synthetic nucleic acid molecule
gagtgagga

SEQ ID NO: 3689 - DNA, 9 bp, Artificial Sequence
  Synthetic nucleic acid molecule
gagtgagga

SEQ ID NO: 3690 - DNA, 9 bp, Artificial Sequence
  Synthetic nucleic acid molecule
gagtgagga

SEQ ID NO: 3691 - DNA, 9 bp, Artificial Sequence
  Synthetic nucleic acid molecule
gaggaaggt

SEQ ID NO: 3692 - DNA, 9 bp, Artificial Sequence
  Synthetic nucleic acid molecule
aagtgaagg

SEQ ID NO: 3693 - DNA, 9 bp, Artificial Sequence
  Synthetic nucleic acid molecule
gagtgagat

SEQ ID NO: 3694 - DNA, 9 bp, Artificial Sequence
  Synthetic nucleic acid molecule
aagtgaggt

SEQ ID NO: 3695 - DNA, 9 bp, Artificial Sequence
  Synthetic nucleic acid molecule
gagtgaggt

SEQ ID NO: 3696 - DNA, 9 bp, Artificial Sequence
  Synthetic nucleic acid molecule
gagtgaggg

SEQ ID NO: 3697 - DNA, 9 bp, Artificial Sequence
  Synthetic nucleic acid molecule
gagtgaggc

SEQ ID NO: 3698 - DNA, 9 bp, Artificial Sequence
  Synthetic nucleic acid molecule
gggtgagaa

SEQ ID NO: 3699 - DNA, 9 bp, Artificial Sequence
  Synthetic nucleic acid molecule
gtgtgggga

SEQ ID NO: 3700 - DNA, 9 bp, Artificial Sequence
  Synthetic nucleic acid molecule
gagtgagaa

SEQ ID NO: 3701 - DNA, 9 bp, Artificial Sequence
  Synthetic nucleic acid molecule
gagtgagca

SEQ ID NO: 3702 - DNA, 9 bp, Artificial Sequence
  Synthetic nucleic acid molecule
gagtgagca

SEQ ID NO: 3703 - DNA, 9 bp, Artificial Sequence
  Synthetic nucleic acid molecule
gagtcagga

SEQ ID NO: 3704 - DNA, 9 bp, Artificial Sequence
  Synthetic nucleic acid molecule
gagagagga

SEQ ID NO: 3705 - DNA, 9 bp, Artificial Sequence
  Synthetic nucleic acid molecule
gagtgagga

SEQ ID NO: 3706 - DNA, 9 bp, Artificial Sequence
  Synthetic nucleic acid molecule
gagtgagga

SEQ ID NO: 3707 - DNA, 9 bp, Artificial Sequence
  Synthetic nucleic acid molecule
gagtgagga

SEQ ID NO: 3708 - DNA, 9 bp, Artificial Sequence
  Synthetic nucleic acid molecule
gagtgagga

SEQ ID NO: 3709 - DNA, 9 bp, Artificial Sequence
  Synthetic nucleic acid molecule
gagtgagga

SEQ ID NO: 3710 - DNA, 9 bp, Artificial Sequence
  Synthetic nucleic acid molecule
gagtgagga

SEQ ID NO: 3711 - DNA, 9 bp, Artificial Sequence
  Synthetic nucleic acid molecule
gagtgagga

SEQ ID NO: 3712 - DNA, 9 bp, Artificial Sequence
  Synthetic nucleic acid molecule
gagtgagga

SEQ ID NO: 3713 - DNA, 9 bp, Artificial Sequence
  Synthetic nucleic acid molecule
gagtgagga

SEQ ID NO: 3714 - DNA, 9 bp, Artificial Sequence
  Synthetic nucleic acid molecule
gagtgagga

SEQ ID NO: 3715 - DNA, 9 bp, Artificial Sequence
  Synthetic nucleic acid molecule
gagtgagga

SEQ ID NO: 3716 - DNA, 9 bp, Artificial Sequence
  Synthetic nucleic acid molecule
gagtgagga

SEQ ID NO: 3717 - DNA, 9 bp, Artificial Sequence
  Synthetic nucleic acid molecule
gagtggcca

SEQ ID NO: 3718 - DNA, 9 bp, Artificial Sequence
  Synthetic nucleic acid molecule
gagtgggcc

SEQ ID NO: 3719 - DNA, 9 bp, Artificial Sequence
  Synthetic nucleic acid molecule
cagtgagac

SEQ ID NO: 3720 - DNA, 9 bp, Artificial Sequence
  Synthetic nucleic acid molecule
gagggaggc

SEQ ID NO: 3721 - DNA, 9 bp, Artificial Sequence
  Synthetic nucleic acid molecule
gagtgagac

SEQ ID NO: 3722 - DNA, 9 bp, Artificial Sequence
  Synthetic nucleic acid molecule
gtgtgaggc

SEQ ID NO: 3723 - DNA, 9 bp, Artificial Sequence
  Synthetic nucleic acid molecule
gggtgaggc

SEQ ID NO: 3724 - DNA, 9 bp, Artificial Sequence
  Synthetic nucleic acid molecule
gagtgagtc

SEQ ID NO: 3725 - DNA, 9 bp, Artificial Sequence
  Synthetic nucleic acid molecule
tagtgaggc

SEQ ID NO: 3726 - DNA, 9 bp, Artificial Sequence
  Synthetic nucleic acid molecule
gagggagaa

SEQ ID NO: 3727 - DNA, 9 bp, Artificial Sequence
  Synthetic nucleic acid molecule
gagggaggc

SEQ ID NO: 3728 - DNA, 9 bp, Artificial Sequence
  Synthetic nucleic acid molecule
cagtgagaa

SEQ ID NO: 3729 - DNA, 9 bp, Artificial Sequence
  Synthetic nucleic acid molecule
gagagaggc

SEQ ID NO: 3730 - DNA, 9 bp, Artificial Sequence
  Synthetic nucleic acid molecule
gagggaggg

SEQ ID NO: 3731 - DNA, 9 bp, Artificial Sequence
  Synthetic nucleic acid molecule
gggtgaggc

SEQ ID NO: 3732 - DNA, 9 bp, Artificial Sequence
  Synthetic nucleic acid molecule
gagtgagaa

SEQ ID NO: 3733 - DNA, 9 bp, Artificial Sequence
  Synthetic nucleic acid molecule
tagtgagga

SEQ ID NO: 3734 - DNA, 9 bp, Artificial Sequence
  Synthetic nucleic acid molecule
gagtgaggc

SEQ ID NO: 3735 - DNA, 9 bp, Artificial Sequence
  Synthetic nucleic acid molecule
gagtgaggg

SEQ ID NO: 3736 - DNA, 9 bp, Artificial Sequence
  Synthetic nucleic acid molecule
tagtgagga

SEQ ID NO: 3737 - DNA, 9 bp, Artificial Sequence
  Synthetic nucleic acid molecule
gagtgaggg

SEQ ID NO: 3738 - DNA, 9 bp, Artificial Sequence
  Synthetic nucleic acid molecule
gagtgagaa

SEQ ID NO: 3739 - DNA, 9 bp, Artificial Sequence
  Synthetic nucleic acid molecule
gagtgaggt

SEQ ID NO: 3740 - DNA, 9 bp, Artificial Sequence
  Synthetic nucleic acid molecule
gagtgaggc

SEQ ID NO: 3741 - DNA, 9 bp, Artificial Sequence
  Synthetic nucleic acid molecule
gagtgaggc

SEQ ID NO: 3742 - DNA, 9 bp, Artificial Sequence
  Synthetic nucleic acid molecule
gagtgaggc

SEQ ID NO: 3743 - DNA, 9 bp, Artificial Sequence
  Synthetic nucleic acid molecule
gagtgaggc

SEQ ID NO: 3744 - DNA, 9 bp, Artificial Sequence
  Synthetic nucleic acid molecule
gagtgaggt

SEQ ID NO: 3745 - DNA, 9 bp, Artificial Sequence
  Synthetic nucleic acid molecule
gagtgaggc

SEQ ID NO: 3746 - DNA, 9 bp, Artificial Sequence
  Synthetic nucleic acid molecule
tagtgagga

SEQ ID NO: 3747 - DNA, 9 bp, Artificial Sequence
  Synthetic nucleic acid molecule
gagtgaggt

SEQ ID NO: 3748 - DNA, 9 bp, Artificial Sequence
  Synthetic nucleic acid molecule
gagtgaggt

SEQ ID NO: 3749 - DNA, 9 bp, Artificial Sequence
  Synthetic nucleic acid molecule
gagtgaggc

SEQ ID NO: 3750 - DNA, 9 bp, Artificial Sequence
  Synthetic nucleic acid molecule
gagtgagaa

SEQ ID NO: 3751 - DNA, 9 bp, Artificial Sequence
  Synthetic nucleic acid molecule
tagtgagga

SEQ ID NO: 3752 - DNA, 9 bp, Artificial Sequence
  Synthetic nucleic acid molecule
gagtgaggc

SEQ ID NO: 3753 - DNA, 9 bp, Artificial Sequence
  Synthetic nucleic acid molecule
gagtgaggc

SEQ ID NO: 3754 - DNA, 9 bp, Artificial Sequence
  Synthetic nucleic acid molecule
gagtgaggc

SEQ ID NO: 3755 - DNA, 9 bp, Artificial Sequence
  Synthetic nucleic acid molecule
gagtgagga

SEQ ID NO: 3756 - DNA, 9 bp, Artificial Sequence
  Synthetic nucleic acid molecule
gagtgagga

SEQ ID NO: 3757 - DNA, 9 bp, Artificial Sequence
  Synthetic nucleic acid molecule
gagtgagga

SEQ ID NO: 3758 - DNA, 9 bp, Artificial Sequence
  Synthetic nucleic acid molecule
gagtgagga

SEQ ID NO: 3759 - DNA, 9 bp, Artificial Sequence
  Synthetic nucleic acid molecule
gagtgagga

SEQ ID NO: 3760 - DNA, 9 bp, Artificial Sequence
  Synthetic nucleic acid molecule
gagtgagga

SEQ ID NO: 3761 - DNA, 9 bp, Artificial Sequence
  Synthetic nucleic acid molecule
gagtgagga

SEQ ID NO: 3762 - DNA, 9 bp, Artificial Sequence
  Synthetic nucleic acid molecule
gagtgagga

SEQ ID NO: 3763 - DNA, 9 bp, Artificial Sequence
  Synthetic nucleic acid molecule
gagtgagga

SEQ ID NO: 3764 - DNA, 9 bp, Artificial Sequence
  Synthetic nucleic acid molecule
gagtgagga

SEQ ID NO: 3765 - DNA, 9 bp, Artificial Sequence
  Synthetic nucleic acid molecule
gagtgagga

SEQ ID NO: 3766 - DNA, 9 bp, Artificial Sequence
  Synthetic nucleic acid molecule
gagtgagga

SEQ ID NO: 3767 - DNA, 9 bp, Artificial Sequence
  Synthetic nucleic acid molecule
gagtgagga

SEQ ID NO: 3768 - DNA, 9 bp, Artificial Sequence
  Synthetic nucleic acid molecule
gagtgagga

SEQ ID NO: 3769 - DNA, 9 bp, Artificial Sequence
  Synthetic nucleic acid molecule
gagtgagga

SEQ ID NO: 3770 - DNA, 9 bp, Artificial Sequence
  Synthetic nucleic acid molecule
gagtgagga

SEQ ID NO: 3771 - DNA, 9 bp, Artificial Sequence
  Synthetic nucleic acid molecule
gagtgagga

SEQ ID NO: 3772 - DNA, 9 bp, Artificial Sequence
  Synthetic nucleic acid molecule
gagtgagga

SEQ ID NO: 3773 - DNA, 9 bp, Artificial Sequence
  Synthetic nucleic acid molecule
gagtgagga

SEQ ID NO: 3774 - DNA, 9 bp, Artificial Sequence
  Synthetic nucleic acid molecule
gagtgagga

SEQ ID NO: 3775 - DNA, 9 bp, Artificial Sequence
  Synthetic nucleic acid molecule
gagtgaggt

SEQ ID NO: 3776 - DNA, 9 bp, Artificial Sequence
  Synthetic nucleic acid molecule
gagtgaggt

SEQ ID NO: 3777 - DNA, 9 bp, Artificial Sequence
  Synthetic nucleic acid molecule
gagtgaggg

SEQ ID NO: 3778 - DNA, 9 bp, Artificial Sequence
  Synthetic nucleic acid molecule
gagtgaggc

SEQ ID NO: 3779 - DNA, 9 bp, Artificial Sequence
  Synthetic nucleic acid molecule
gagtgaggt

SEQ ID NO: 3780 - DNA, 9 bp, Artificial Sequence
  Synthetic nucleic acid molecule
aagttagga

SEQ ID NO: 3781 - DNA, 9 bp, Artificial Sequence
  Synthetic nucleic acid molecule
gaggcagga

SEQ ID NO: 3782 - DNA, 9 bp, Artificial Sequence
  Synthetic nucleic acid molecule
gggtgagga

SEQ ID NO: 3783 - DNA, 9 bp, Artificial Sequence
  Synthetic nucleic acid molecule
gagtgagta

SEQ ID NO: 3784 - DNA, 9 bp, Artificial Sequence
  Synthetic nucleic acid molecule
cagtgagga

SEQ ID NO: 3785 - DNA, 9 bp, Artificial Sequence
  Synthetic nucleic acid molecule
gagagagga

SEQ ID NO: 3786 - DNA, 9 bp, Artificial Sequence
  Synthetic nucleic acid molecule
gagtgtgga

SEQ ID NO: 3787 - DNA, 9 bp, Artificial Sequence
  Synthetic nucleic acid molecule
gtgtgagga

SEQ ID NO: 3788 - DNA, 9 bp, Artificial Sequence
  Synthetic nucleic acid molecule
gagggagga

SEQ ID NO: 3789 - DNA, 9 bp, Artificial Sequence
  Synthetic nucleic acid molecule
gaatgagga

SEQ ID NO: 3790 - DNA, 9 bp, Artificial Sequence
  Synthetic nucleic acid molecule
gagggagga

SEQ ID NO: 3791 - DNA, 9 bp, Artificial Sequence
  Synthetic nucleic acid molecule
cagtgagga

SEQ ID NO: 3792 - DNA, 9 bp, Artificial Sequence
  Synthetic nucleic acid molecule
cagtgagga

SEQ ID NO: 3793 - DNA, 9 bp, Artificial Sequence
  Synthetic nucleic acid molecule
gggtgagga

SEQ ID NO: 3794 - DNA, 9 bp, Artificial Sequence
  Synthetic nucleic acid molecule
aagtgagga

SEQ ID NO: 3795 - DNA, 9 bp, Artificial Sequence
  Synthetic nucleic acid molecule
aagtgagga

SEQ ID NO: 3796 - DNA, 9 bp, Artificial Sequence
  Synthetic nucleic acid molecule
gagttagga

SEQ ID NO: 3797 - DNA, 9 bp, Artificial Sequence
  Synthetic nucleic acid molecule
cagtgagga

SEQ ID NO: 3798 - DNA, 9 bp, Artificial Sequence
  Synthetic nucleic acid molecule
cagtgagga

SEQ ID NO: 3799 - DNA, 9 bp, Artificial Sequence
  Synthetic nucleic acid molecule
gtgtgagga

SEQ ID NO: 3800 - DNA, 9 bp, Artificial Sequence
  Synthetic nucleic acid molecule
cagtgagga

SEQ ID NO: 3801 - DNA, 9 bp, Artificial Sequence
  Synthetic nucleic acid molecule
aagtgagga

SEQ ID NO: 3802 - DNA, 9 bp, Artificial Sequence
  Synthetic nucleic acid molecule
gtgtgagga

SEQ ID NO: 3803 - DNA, 9 bp, Artificial Sequence
  Synthetic nucleic acid molecule
gagttagga

SEQ ID NO: 3804 - DNA, 9 bp, Artificial Sequence
  Synthetic nucleic acid molecule
gagcgagga

SEQ ID NO: 3805 - DNA, 9 bp, Artificial Sequence
  Synthetic nucleic acid molecule
aagtgagga

SEQ ID NO: 3806 - DNA, 9 bp, Artificial Sequence
  Synthetic nucleic acid molecule
gggtgagga

SEQ ID NO: 3807 - DNA, 9 bp, Artificial Sequence
  Synthetic nucleic acid molecule
gagagagga

SEQ ID NO: 3808 - DNA, 9 bp, Artificial Sequence
  Synthetic nucleic acid molecule
cagtgagga

SEQ ID NO: 3809 - DNA, 9 bp, Artificial Sequence
  Synthetic nucleic acid molecule
gagtgtgga

SEQ ID NO: 3810 - DNA, 9 bp, Artificial Sequence
  Synthetic nucleic acid molecule
gagtgtgga

SEQ ID NO: 3811 - DNA, 9 bp, Artificial Sequence
  Synthetic nucleic acid molecule
gagtgaaga

SEQ ID NO: 3812 - DNA, 9 bp, Artificial Sequence
  Synthetic nucleic acid molecule
gagtgaaga

SEQ ID NO: 3813 - DNA, 9 bp, Artificial Sequence
  Synthetic nucleic acid molecule
gagcgagga

SEQ ID NO: 3814 - DNA, 9 bp, Artificial Sequence
  Synthetic nucleic acid molecule
gagcgagga

SEQ ID NO: 3815 - DNA, 9 bp, Artificial Sequence
  Synthetic nucleic acid molecule
gagcgagga

SEQ ID NO: 3816 - DNA, 9 bp, Artificial Sequence
  Synthetic nucleic acid molecule
gagcgagga

SEQ ID NO: 3817 - DNA, 9 bp, Artificial Sequence
  Synthetic nucleic acid molecule
gagcgagga

SEQ ID NO: 3818 - DNA, 9 bp, Artificial Sequence
  Synthetic nucleic acid molecule
gagcgagga

SEQ ID NO: 3819 - DNA, 9 bp, Artificial Sequence
  Synthetic nucleic acid molecule
gagcgagga

SEQ ID NO: 3820 - DNA, 9 bp, Artificial Sequence
  Synthetic nucleic acid molecule
gagcgagga

SEQ ID NO: 3821 - DNA, 9 bp, Artificial Sequence
  Synthetic nucleic acid molecule
cagtgagga

SEQ ID NO: 3822 - DNA, 9 bp, Artificial Sequence
  Synthetic nucleic acid molecule
gagtgaaga

SEQ ID NO: 3823 - DNA, 9 bp, Artificial Sequence
  Synthetic nucleic acid molecule
aagtgagga

SEQ ID NO: 3824 - DNA, 9 bp, Artificial Sequence
  Synthetic nucleic acid molecule
gagtgtgga

SEQ ID NO: 3825 - DNA, 9 bp, Artificial Sequence
  Synthetic nucleic acid molecule
gaatgagga

SEQ ID NO: 3826 - DNA, 9 bp, Artificial Sequence
  Synthetic nucleic acid molecule
gagagagga

SEQ ID NO: 3827 - DNA, 9 bp, Artificial Sequence
  Synthetic nucleic acid molecule
gagtcagga

SEQ ID NO: 3828 - DNA, 9 bp, Artificial Sequence
  Synthetic nucleic acid molecule
gagtgggga

SEQ ID NO: 3829 - DNA, 9 bp, Artificial Sequence
  Synthetic nucleic acid molecule
gagagagga

SEQ ID NO: 3830 - DNA, 9 bp, Artificial Sequence
  Synthetic nucleic acid molecule
gagtgagaa

SEQ ID NO: 3831 - DNA, 9 bp, Artificial Sequence
  Synthetic nucleic acid molecule
gagtgggga

SEQ ID NO: 3832 - DNA, 9 bp, Artificial Sequence
  Synthetic nucleic acid molecule
cagtgagga

SEQ ID NO: 3833 - DNA, 9 bp, Artificial Sequence
  Synthetic nucleic acid molecule
aagtgagga

SEQ ID NO: 3834 - DNA, 9 bp, Artificial Sequence
  Synthetic nucleic acid molecule
gtgtgagga

SEQ ID NO: 3835 - DNA, 9 bp, Artificial Sequence
  Synthetic nucleic acid molecule
gagtgtgga

SEQ ID NO: 3836 - DNA, 9 bp, Artificial Sequence
  Synthetic nucleic acid molecule
gagtgagga

SEQ ID NO: 3837 - DNA, 9 bp, Artificial Sequence
  Synthetic nucleic acid molecule
gagtgagga

SEQ ID NO: 3838 - DNA, 9 bp, Artificial Sequence
  Synthetic nucleic acid molecule
gagtgagga

SEQ ID NO: 3839 - DNA, 9 bp, Artificial Sequence
  Synthetic nucleic acid molecule
gagtgagga

SEQ ID NO: 3840 - DNA, 9 bp, Artificial Sequence
  Synthetic nucleic acid molecule
gagtgagga

SEQ ID NO: 3841 - DNA, 9 bp, Artificial Sequence
  Synthetic nucleic acid molecule
gagtgagga

SEQ ID NO: 3842 - DNA, 9 bp, Artificial Sequence
  Synthetic nucleic acid molecule
gagtgagga

SEQ ID NO: 3843 - DNA, 9 bp, Artificial Sequence
  Synthetic nucleic acid molecule
gagtgagga

SEQ ID NO: 3844 - DNA, 9 bp, Artificial Sequence
  Synthetic nucleic acid molecule
gagtgagga

SEQ ID NO: 3845 - DNA, 9 bp, Artificial Sequence
  Synthetic nucleic acid molecule
gagtgagga

SEQ ID NO: 3846 - DNA, 9 bp, Artificial Sequence
  Synthetic nucleic acid molecule
gagtgagga

SEQ ID NO: 3847 - DNA, 9 bp, Artificial Sequence
  Synthetic nucleic acid molecule
gagtgagga

SEQ ID NO: 3848 - DNA, 9 bp, Artificial Sequence
  Synthetic nucleic acid molecule
gagtgagga

SEQ ID NO: 3849 - DNA, 9 bp, Artificial Sequence
  Synthetic nucleic acid molecule
gagtgagga

SEQ ID NO: 3850 - DNA, 9 bp, Artificial Sequence
  Synthetic nucleic acid molecule
gagtgagga

SEQ ID NO: 3851 - DNA, 9 bp, Artificial Sequence
  Synthetic nucleic acid molecule
gagtgagga

SEQ ID NO: 3852 - DNA, 9 bp, Artificial Sequence
  Synthetic nucleic acid molecule
gagtgagga

SEQ ID NO: 3853 - DNA, 9 bp, Artificial Sequence
  Synthetic nucleic acid molecule
gagtgagga

SEQ ID NO: 3854 - DNA, 9 bp, Artificial Sequence
  Synthetic nucleic acid molecule
gagtgagga

SEQ ID NO: 3855 - DNA, 9 bp, Artificial Sequence
  Synthetic nucleic acid molecule
gagtgagga

SEQ ID NO: 3856 - DNA, 9 bp, Artificial Sequence
  Synthetic nucleic acid molecule
gagtgagga

SEQ ID NO: 3857 - DNA, 9 bp, Artificial Sequence
  Synthetic nucleic acid molecule
gagtgagga

SEQ ID NO: 3858 - DNA, 9 bp, Artificial Sequence
  Synthetic nucleic acid molecule
gagtgagga

SEQ ID NO: 3859 - DNA, 9 bp, Artificial Sequence
  Synthetic nucleic acid molecule
ttgtgggga

SEQ ID NO: 3860 - DNA, 9 bp, Artificial Sequence
  Synthetic nucleic acid molecule
ttgtgggga

SEQ ID NO: 3861 - DNA, 9 bp, Artificial Sequence
  Synthetic nucleic acid molecule
gagttacaa

SEQ ID NO: 3862 - DNA, 9 bp, Artificial Sequence
  Synthetic nucleic acid molecule
ttgagagga

SEQ ID NO: 3863 - DNA, 9 bp, Artificial Sequence
  Synthetic nucleic acid molecule
cagtgtgaa

SEQ ID NO: 3864 - DNA, 9 bp, Artificial Sequence
  Synthetic nucleic acid molecule
cagtgtgaa

SEQ ID NO: 3865 - DNA, 9 bp, Artificial Sequence
  Synthetic nucleic acid molecule
gagagaagg

SEQ ID NO: 3866 - DNA, 9 bp, Artificial Sequence
  Synthetic nucleic acid molecule
gagttgggg

SEQ ID NO: 3867 - DNA, 9 bp, Artificial Sequence
  Synthetic nucleic acid molecule
gaacgtgga

SEQ ID NO: 3868 - DNA, 9 bp, Artificial Sequence
  Synthetic nucleic acid molecule
gagtttggg

SEQ ID NO: 3869 - DNA, 9 bp, Artificial Sequence
  Synthetic nucleic acid molecule
aggggagga

SEQ ID NO: 3870 - DNA, 9 bp, Artificial Sequence
  Synthetic nucleic acid molecule
ggctgaggg

SEQ ID NO: 3871 - DNA, 9 bp, Artificial Sequence
  Synthetic nucleic acid molecule
cagtggggc

SEQ ID NO: 3872 - DNA, 9 bp, Artificial Sequence
  Synthetic nucleic acid molecule
gagggggca

SEQ ID NO: 3873 - DNA, 9 bp, Artificial Sequence
  Synthetic nucleic acid molecule
gggagaggc

SEQ ID NO: 3874 - DNA, 9 bp, Artificial Sequence
  Synthetic nucleic acid molecule
gagtggagc

SEQ ID NO: 3875 - DNA, 9 bp, Artificial Sequence
  Synthetic nucleic acid molecule
cagagaggc

SEQ ID NO: 3876 - DNA, 9 bp, Artificial Sequence
  Synthetic nucleic acid molecule
gtgtcagaa

SEQ ID NO: 3877 - DNA, 9 bp, Artificial Sequence
  Synthetic nucleic acid molecule
gcatgagca

SEQ ID NO: 3878 - DNA, 9 bp, Artificial Sequence
  Synthetic nucleic acid molecule
aagggaaga

SEQ ID NO: 3879 - DNA, 9 bp, Artificial Sequence
  Synthetic nucleic acid molecule
gagttgtga

SEQ ID NO: 3880 - DNA, 9 bp, Artificial Sequence
  Synthetic nucleic acid molecule
gagtgctca

SEQ ID NO: 3881 - DNA, 9 bp, Artificial Sequence
  Synthetic nucleic acid molecule
ttgagagga

SEQ ID NO: 3882 - DNA, 9 bp, Artificial Sequence
  Synthetic nucleic acid molecule
gtgtaatga

SEQ ID NO: 3883 - DNA, 9 bp, Artificial Sequence
  Synthetic nucleic acid molecule
gagtgggtt

SEQ ID NO: 3884 - DNA, 9 bp, Artificial Sequence
  Synthetic nucleic acid molecule
gaggcagaa

SEQ ID NO: 3885 - DNA, 9 bp, Artificial Sequence
  Synthetic nucleic acid molecule
cagtgtgaa

SEQ ID NO: 3886 - DNA, 9 bp, Artificial Sequence
  Synthetic nucleic acid molecule
cagtgtgaa

SEQ ID NO: 3887 - DNA, 9 bp, Artificial Sequence
  Synthetic nucleic acid molecule
cagtgtgaa

SEQ ID NO: 3888 - DNA, 9 bp, Artificial Sequence
  Synthetic nucleic acid molecule
cagtgtgaa

SEQ ID NO: 3889 - DNA, 9 bp, Artificial Sequence
  Synthetic nucleic acid molecule
cagtgtgaa

SEQ ID NO: 3890 - DNA, 9 bp, Artificial Sequence
  Synthetic nucleic acid molecule
cagtgtgaa

SEQ ID NO: 3891 - DNA, 9 bp, Artificial Sequence
  Synthetic nucleic acid molecule
cagtgtgaa

SEQ ID NO: 3892 - DNA, 9 bp, Artificial Sequence
  Synthetic nucleic acid molecule
ttgagagga

SEQ ID NO: 3893 - DNA, 9 bp, Artificial Sequence
  Synthetic nucleic acid molecule
tactgaggt

SEQ ID NO: 3894 - DNA, 9 bp, Artificial Sequence
  Synthetic nucleic acid molecule
cagcgaggt

SEQ ID NO: 3895 - DNA, 9 bp, Artificial Sequence
  Synthetic nucleic acid molecule
gacagaggt

SEQ ID NO: 3896 - DNA, 9 bp, Artificial Sequence
  Synthetic nucleic acid molecule
gagagagct

SEQ ID NO: 3897 - DNA, 9 bp, Artificial Sequence
  Synthetic nucleic acid molecule
gaggaaggc

SEQ ID NO: 3898 - DNA, 9 bp, Artificial Sequence
  Synthetic nucleic acid molecule
ggctgaggt

SEQ ID NO: 3899 - DNA, 9 bp, Artificial Sequence
  Synthetic nucleic acid molecule
gaaggaggt

SEQ ID NO: 3900 - DNA, 9 bp, Artificial Sequence
  Synthetic nucleic acid molecule
gagcgatgg

SEQ ID NO: 3901 - DNA, 9 bp, Artificial Sequence
  Synthetic nucleic acid molecule
aagggagaa

SEQ ID NO: 3902 - DNA, 9 bp, Artificial Sequence
  Synthetic nucleic acid molecule
ttgagagga

SEQ ID NO: 3903 - DNA, 9 bp, Artificial Sequence
  Synthetic nucleic acid molecule
gtgtgcggt

SEQ ID NO: 3904 - DNA, 9 bp, Artificial Sequence
  Synthetic nucleic acid molecule
tagagggga

SEQ ID NO: 3905 - DNA, 9 bp, Artificial Sequence
  Synthetic nucleic acid molecule
gaggtaggg

SEQ ID NO: 3906 - DNA, 9 bp, Artificial Sequence
  Synthetic nucleic acid molecule
gtgttacga

SEQ ID NO: 3907 - DNA, 9 bp, Artificial Sequence
  Synthetic nucleic acid molecule
ctgtgaggg

SEQ ID NO: 3908 - DNA, 9 bp, Artificial Sequence
  Synthetic nucleic acid molecule
gagggagag

SEQ ID NO: 3909 - DNA, 9 bp, Artificial Sequence
  Synthetic nucleic acid molecule
gaggggaga

SEQ ID NO: 3910 - DNA, 9 bp, Artificial Sequence
  Synthetic nucleic acid molecule
cagtgatgg

SEQ ID NO: 3911 - DNA, 9 bp, Artificial Sequence
  Synthetic nucleic acid molecule
gagagaagg

SEQ ID NO: 3912 - DNA, 9 bp, Artificial Sequence
  Synthetic nucleic acid molecule
gagtccaga

SEQ ID NO: 3913 - DNA, 9 bp, Artificial Sequence
  Synthetic nucleic acid molecule
tagagagta

SEQ ID NO: 3914 - DNA, 9 bp, Artificial Sequence
  Synthetic nucleic acid molecule
gagagaagg

SEQ ID NO: 3915 - DNA, 9 bp, Artificial Sequence
  Synthetic nucleic acid molecule
gagtgtgaa

SEQ ID NO: 3916 - DNA, 9 bp, Artificial Sequence
  Synthetic nucleic acid molecule
gagtgagac

SEQ ID NO: 3917 - DNA, 9 bp, Artificial Sequence
  Synthetic nucleic acid molecule
gagggaggg

SEQ ID NO: 3918 - DNA, 9 bp, Artificial Sequence
  Synthetic nucleic acid molecule
cagtgaggt

SEQ ID NO: 3919 - DNA, 9 bp, Artificial Sequence
  Synthetic nucleic acid molecule
gagggaggc

SEQ ID NO: 3920 - DNA, 9 bp, Artificial Sequence
  Synthetic nucleic acid molecule
gagtgatgt

SEQ ID NO: 3921 - DNA, 9 bp, Artificial Sequence
  Synthetic nucleic acid molecule
gagtgagtg

SEQ ID NO: 3922 - DNA, 9 bp, Artificial Sequence
  Synthetic nucleic acid molecule
gagagaggc

SEQ ID NO: 3923 - DNA, 9 bp, Artificial Sequence
  Synthetic nucleic acid molecule
gagtaaggt

SEQ ID NO: 3924 - DNA, 9 bp, Artificial Sequence
  Synthetic nucleic acid molecule
tagtgagaa

SEQ ID NO: 3925 - DNA, 9 bp, Artificial Sequence
  Synthetic nucleic acid molecule
gagggaaga

SEQ ID NO: 3926 - DNA, 9 bp, Artificial Sequence
  Synthetic nucleic acid molecule
gagggaggc

SEQ ID NO: 3927 - DNA, 9 bp, Artificial Sequence
  Synthetic nucleic acid molecule
gagtgagag

SEQ ID NO: 3928 - DNA, 9 bp, Artificial Sequence
  Synthetic nucleic acid molecule
aagtgaggg

SEQ ID NO: 3929 - DNA, 9 bp, Artificial Sequence
  Synthetic nucleic acid molecule
cagtgggga

SEQ ID NO: 3930 - DNA, 9 bp, Artificial Sequence
  Synthetic nucleic acid molecule
gtctgagga

SEQ ID NO: 3931 - DNA, 9 bp, Artificial Sequence
  Synthetic nucleic acid molecule
tagtgagaa

SEQ ID NO: 3932 - DNA, 9 bp, Artificial Sequence
  Synthetic nucleic acid molecule
gagtggggt

SEQ ID NO: 3933 - DNA, 9 bp, Artificial Sequence
  Synthetic nucleic acid molecule
cagtgaggt

SEQ ID NO: 3934 - DNA, 9 bp, Artificial Sequence
  Synthetic nucleic acid molecule
tagtgaggg

SEQ ID NO: 3935 - DNA, 9 bp, Artificial Sequence
  Synthetic nucleic acid molecule
gagtgagcc

SEQ ID NO: 3936 - DNA, 9 bp, Artificial Sequence
  Synthetic nucleic acid molecule
aagtgagaa

SEQ ID NO: 3937 - DNA, 9 bp, Artificial Sequence
  Synthetic nucleic acid molecule
gagagagaa

SEQ ID NO: 3938 - DNA, 9 bp, Artificial Sequence
  Synthetic nucleic acid molecule
cagtaagga

SEQ ID NO: 3939 - DNA, 9 bp, Artificial Sequence
  Synthetic nucleic acid molecule
gagtgagtg

SEQ ID NO: 3940 - DNA, 9 bp, Artificial Sequence
  Synthetic nucleic acid molecule
gagggaggg

SEQ ID NO: 3941 - DNA, 9 bp, Artificial Sequence
  Synthetic nucleic acid molecule
gggtgaggc

SEQ ID NO: 3942 - DNA, 9 bp, Artificial Sequence
  Synthetic nucleic acid molecule
gagcgaggg

SEQ ID NO: 3943 - DNA, 9 bp, Artificial Sequence
  Synthetic nucleic acid molecule
cagtgaggt

SEQ ID NO: 3944 - DNA, 9 bp, Artificial Sequence
  Synthetic nucleic acid molecule
gtgtgaggt

SEQ ID NO: 3945 - DNA, 9 bp, Artificial Sequence
  Synthetic nucleic acid molecule
cagtgaggc

SEQ ID NO: 3946 - DNA, 9 bp, Artificial Sequence
  Synthetic nucleic acid molecule
gagggagaa

SEQ ID NO: 3947 - DNA, 9 bp, Artificial Sequence
  Synthetic nucleic acid molecule
gagggaggg

SEQ ID NO: 3948 - DNA, 9 bp, Artificial Sequence
  Synthetic nucleic acid molecule
gagtgagcc

SEQ ID NO: 3949 - DNA, 9 bp, Artificial Sequence
  Synthetic nucleic acid molecule
gagggaggg

SEQ ID NO: 3950 - DNA, 9 bp, Artificial Sequence
  Synthetic nucleic acid molecule
gagggaggg

SEQ ID NO: 3951 - DNA, 9 bp, Artificial Sequence
  Synthetic nucleic acid molecule
gagggaggg

SEQ ID NO: 3952 - DNA, 9 bp, Artificial Sequence
  Synthetic nucleic acid molecule
gagggaggg

SEQ ID NO: 3953 - DNA, 9 bp, Artificial Sequence
  Synthetic nucleic acid molecule
gagggaggg

SEQ ID NO: 3954 - DNA, 9 bp, Artificial Sequence
  Synthetic nucleic acid molecule
gagggaggg

SEQ ID NO: 3955 - DNA, 9 bp, Artificial Sequence
  Synthetic nucleic acid molecule
gagggaggg

SEQ ID NO: 3956 - DNA, 9 bp, Artificial Sequence
  Synthetic nucleic acid molecule
gagggaggg

SEQ ID NO: 3957 - DNA, 9 bp, Artificial Sequence
  Synthetic nucleic acid molecule
cagtgaggg

SEQ ID NO: 3958 - DNA, 9 bp, Artificial Sequence
  Synthetic nucleic acid molecule
gtgtgagaa

SEQ ID NO: 3959 - DNA, 9 bp, Artificial Sequence
  Synthetic nucleic acid molecule
tagtgaggg

SEQ ID NO: 3960 - DNA, 9 bp, Artificial Sequence
  Synthetic nucleic acid molecule
gagggaggt

SEQ ID NO: 3961 - DNA, 9 bp, Artificial Sequence
  Synthetic nucleic acid molecule
cagtgaggg

SEQ ID NO: 3962 - DNA, 9 bp, Artificial Sequence
  Synthetic nucleic acid molecule
gagggaggc

SEQ ID NO: 3963 - DNA, 9 bp, Artificial Sequence
  Synthetic nucleic acid molecule
gagtggggc

SEQ ID NO: 3964 - DNA, 9 bp, Artificial Sequence
  Synthetic nucleic acid molecule
gagtgacaa

SEQ ID NO: 3965 - DNA, 9 bp, Artificial Sequence
  Synthetic nucleic acid molecule
gagtgatgt

SEQ ID NO: 3966 - DNA, 9 bp, Artificial Sequence
  Synthetic nucleic acid molecule
gagtgagtt

SEQ ID NO: 3967 - DNA, 9 bp, Artificial Sequence
  Synthetic nucleic acid molecule
gagggaggc

SEQ ID NO: 3968 - DNA, 9 bp, Artificial Sequence
  Synthetic nucleic acid molecule
gagagaggc

SEQ ID NO: 3969 - DNA, 9 bp, Artificial Sequence
  Synthetic nucleic acid molecule
cagtgaggg

SEQ ID NO: 3970 - DNA, 9 bp, Artificial Sequence
  Synthetic nucleic acid molecule
gagtgagtt

SEQ ID NO: 3971 - DNA, 9 bp, Artificial Sequence
  Synthetic nucleic acid molecule
gagtgagtt

SEQ ID NO: 3972 - DNA, 9 bp, Artificial Sequence
  Synthetic nucleic acid molecule
gagggaggt

SEQ ID NO: 3973 - DNA, 9 bp, Artificial Sequence
  Synthetic nucleic acid molecule
gggtgaggg

SEQ ID NO: 3974 - DNA, 9 bp, Artificial Sequence
  Synthetic nucleic acid molecule
cagtgaggc

SEQ ID NO: 3975 - DNA, 9 bp, Artificial Sequence
  Synthetic nucleic acid molecule
gagagaggt

SEQ ID NO: 3976 - DNA, 9 bp, Artificial Sequence
  Synthetic nucleic acid molecule
gagtgagcc

SEQ ID NO: 3977 - DNA, 9 bp, Artificial Sequence
  Synthetic nucleic acid molecule
gagtgaagg

SEQ ID NO: 3978 - DNA, 9 bp, Artificial Sequence
  Synthetic nucleic acid molecule
tagtgaggg

SEQ ID NO: 3979 - DNA, 9 bp, Artificial Sequence
  Synthetic nucleic acid molecule
tagtgaggg

SEQ ID NO: 3980 - DNA, 9 bp, Artificial Sequence
  Synthetic nucleic acid molecule
gaggaagga

SEQ ID NO: 3981 - DNA, 9 bp, Artificial Sequence
  Synthetic nucleic acid molecule
gagagaggt

SEQ ID NO: 3982 - DNA, 9 bp, Artificial Sequence
  Synthetic nucleic acid molecule
gggtgaggg

SEQ ID NO: 3983 - DNA, 9 bp, Artificial Sequence
  Synthetic nucleic acid molecule
gagtgaagg

SEQ ID NO: 3984 - DNA, 9 bp, Artificial Sequence
  Synthetic nucleic acid molecule
tggtgagga

SEQ ID NO: 3985 - DNA, 9 bp, Artificial Sequence
  Synthetic nucleic acid molecule
gagagaggg

SEQ ID NO: 3986 - DNA, 9 bp, Artificial Sequence
  Synthetic nucleic acid molecule
gagagaggc

SEQ ID NO: 3987 - DNA, 9 bp, Artificial Sequence
  Synthetic nucleic acid molecule
gactgaggc

SEQ ID NO: 3988 - DNA, 9 bp, Artificial Sequence
  Synthetic nucleic acid molecule
gtgtgaggc

SEQ ID NO: 3989 - DNA, 9 bp, Artificial Sequence
  Synthetic nucleic acid molecule
gactgaggc

SEQ ID NO: 3990 - DNA, 9 bp, Artificial Sequence
  Synthetic nucleic acid molecule
gagagaggg

SEQ ID NO: 3991 - DNA, 9 bp, Artificial Sequence
  Synthetic nucleic acid molecule
gactgaggc

SEQ ID NO: 3992 - DNA, 9 bp, Artificial Sequence
  Synthetic nucleic acid molecule
gactgaggc

SEQ ID NO: 3993 - DNA, 9 bp, Artificial Sequence
  Synthetic nucleic acid molecule
gactgaggc

SEQ ID NO: 3994 - DNA, 9 bp, Artificial Sequence
  Synthetic nucleic acid molecule
gactgaggc

SEQ ID NO: 3995 - DNA, 9 bp, Artificial Sequence
  Synthetic nucleic acid molecule
gactgaggc

SEQ ID NO: 3996 - DNA, 9 bp, Artificial Sequence
  Synthetic nucleic acid molecule
gagagaggg

SEQ ID NO: 3997 - DNA, 9 bp, Artificial Sequence
  Synthetic nucleic acid molecule
gactgaggc

SEQ ID NO: 3998 - DNA, 9 bp, Artificial Sequence
  Synthetic nucleic acid molecule
tagtgaggc

SEQ ID NO: 3999 - DNA, 9 bp, Artificial Sequence
  Synthetic nucleic acid molecule
gtgtgagaa

SEQ ID NO: 4000 - DNA, 9 bp, Artificial Sequence
  Synthetic nucleic acid molecule
gaatgaggg

SEQ ID NO: 4001 - DNA, 9 bp, Artificial Sequence
  Synthetic nucleic acid molecule
gggtgaggt

SEQ ID NO: 4002 - DNA, 9 bp, Artificial Sequence
  Synthetic nucleic acid molecule
gaatgaggg

SEQ ID NO: 4003 - DNA, 9 bp, Artificial Sequence
  Synthetic nucleic acid molecule
gagtgtggt

SEQ ID NO: 4004 - DNA, 9 bp, Artificial Sequence
  Synthetic nucleic acid molecule
gagtgagcc

SEQ ID NO: 4005 - DNA, 9 bp, Artificial Sequence
  Synthetic nucleic acid molecule
gagtgggaa

SEQ ID NO: 4006 - DNA, 9 bp, Artificial Sequence
  Synthetic nucleic acid molecule
cagtgaggg

SEQ ID NO: 4007 - DNA, 9 bp, Artificial Sequence
  Synthetic nucleic acid molecule
gactgaggg

SEQ ID NO: 4008 - DNA, 9 bp, Artificial Sequence
  Synthetic nucleic acid molecule
gagtgagct

SEQ ID NO: 4009 - DNA, 9 bp, Artificial Sequence
  Synthetic nucleic acid molecule
gggagagga

SEQ ID NO: 4010 - DNA, 9 bp, Artificial Sequence
  Synthetic nucleic acid molecule
gagtgatgt

SEQ ID NO: 4011 - DNA, 9 bp, Artificial Sequence
  Synthetic nucleic acid molecule
gagtgggaa

SEQ ID NO: 4012 - DNA, 9 bp, Artificial Sequence
  Synthetic nucleic acid molecule
cagtgaggt

SEQ ID NO: 4013 - DNA, 9 bp, Artificial Sequence
  Synthetic nucleic acid molecule
gagagagca

SEQ ID NO: 4014 - DNA, 9 bp, Artificial Sequence
  Synthetic nucleic acid molecule
tagtgaggt

SEQ ID NO: 4015 - DNA, 9 bp, Artificial Sequence
  Synthetic nucleic acid molecule
gagagaggg

SEQ ID NO: 4016 - DNA, 9 bp, Artificial Sequence
  Synthetic nucleic acid molecule
cagtgagta

SEQ ID NO: 4017 - DNA, 9 bp, Artificial Sequence
  Synthetic nucleic acid molecule
gagggtgga

SEQ ID NO: 4018 - DNA, 9 bp, Artificial Sequence
  Synthetic nucleic acid molecule
gagggaggt

SEQ ID NO: 4019 - DNA, 9 bp, Artificial Sequence
  Synthetic nucleic acid molecule
gagtaaggc

SEQ ID NO: 4020 - DNA, 9 bp, Artificial Sequence
  Synthetic nucleic acid molecule
gagtggggg

SEQ ID NO: 4021 - DNA, 9 bp, Artificial Sequence
  Synthetic nucleic acid molecule
gagggaggg

SEQ ID NO: 4022 - DNA, 9 bp, Artificial Sequence
  Synthetic nucleic acid molecule
gagggaggg

SEQ ID NO: 4023 - DNA, 9 bp, Artificial Sequence
  Synthetic nucleic acid molecule
gagggaggg

SEQ ID NO: 4024 - DNA, 9 bp, Artificial Sequence
  Synthetic nucleic acid molecule
gagggaggg

SEQ ID NO: 4025 - DNA, 9 bp, Artificial Sequence
  Synthetic nucleic acid molecule
gagggaggg

SEQ ID NO: 4026 - DNA, 9 bp, Artificial Sequence
  Synthetic nucleic acid molecule
gagggaggg

SEQ ID NO: 4027 - DNA, 9 bp, Artificial Sequence
  Synthetic nucleic acid molecule
gagggaggg

SEQ ID NO: 4028 - DNA, 9 bp, Artificial Sequence
  Synthetic nucleic acid molecule
gagggaggg

SEQ ID NO: 4029 - DNA, 9 bp, Artificial Sequence
  Synthetic nucleic acid molecule
gagggaggg

SEQ ID NO: 4030 - DNA, 9 bp, Artificial Sequence
  Synthetic nucleic acid molecule
gagggaggg

SEQ ID NO: 4031 - DNA, 9 bp, Artificial Sequence
  Synthetic nucleic acid molecule
gagggaggg

SEQ ID NO: 4032 - DNA, 9 bp, Artificial Sequence
  Synthetic nucleic acid molecule
cagtgaggg

SEQ ID NO: 4033 - DNA, 9 bp, Artificial Sequence
  Synthetic nucleic acid molecule
gagggaggg

SEQ ID NO: 4034 - DNA, 9 bp, Artificial Sequence
  Synthetic nucleic acid molecule
gtgtgaggg

SEQ ID NO: 4035 - DNA, 9 bp, Artificial Sequence
  Synthetic nucleic acid molecule
gagggaggg

SEQ ID NO: 4036 - DNA, 9 bp, Artificial Sequence
  Synthetic nucleic acid molecule
gagggaggc

SEQ ID NO: 4037 - DNA, 9 bp, Artificial Sequence
  Synthetic nucleic acid molecule
gagtggggg

SEQ ID NO: 4038 - DNA, 9 bp, Artificial Sequence
  Synthetic nucleic acid molecule
gagagaggg

SEQ ID NO: 4039 - DNA, 9 bp, Artificial Sequence
  Synthetic nucleic acid molecule
gtgggagga

SEQ ID NO: 4040 - DNA, 9 bp, Artificial Sequence
  Synthetic nucleic acid molecule
gggtgaggg

SEQ ID NO: 4041 - DNA, 9 bp, Artificial Sequence
  Synthetic nucleic acid molecule
cagtgaggt

SEQ ID NO: 4042 - DNA, 9 bp, Artificial Sequence
  Synthetic nucleic acid molecule
gagtgtggt

SEQ ID NO: 4043 - DNA, 9 bp, Artificial Sequence
  Synthetic nucleic acid molecule
cagtgaggg

SEQ ID NO: 4044 - DNA, 9 bp, Artificial Sequence
  Synthetic nucleic acid molecule
gagtggggt

SEQ ID NO: 4045 - DNA, 9 bp, Artificial Sequence
  Synthetic nucleic acid molecule
gagcgggga

SEQ ID NO: 4046 - DNA, 9 bp, Artificial Sequence
  Synthetic nucleic acid molecule
aagtgaggg

SEQ ID NO: 4047 - DNA, 9 bp, Artificial Sequence
  Synthetic nucleic acid molecule
gagagaggg

SEQ ID NO: 4048 - DNA, 9 bp, Artificial Sequence
  Synthetic nucleic acid molecule
gagtaaggg

SEQ ID NO: 4049 - DNA, 9 bp, Artificial Sequence
  Synthetic nucleic acid molecule
gagttaggt

SEQ ID NO: 4050 - DNA, 9 bp, Artificial Sequence
  Synthetic nucleic acid molecule
gtgtgaggc

SEQ ID NO: 4051 - DNA, 9 bp, Artificial Sequence
  Synthetic nucleic acid molecule
aagtgaggc

SEQ ID NO: 4052 - DNA, 9 bp, Artificial Sequence
  Synthetic nucleic acid molecule
aagtgagga

SEQ ID NO: 4053 - DNA, 9 bp, Artificial Sequence
  Synthetic nucleic acid molecule
aagtgagga

SEQ ID NO: 4054 - DNA, 9 bp, Artificial Sequence
  Synthetic nucleic acid molecule
aagtgagga

SEQ ID NO: 4055 - DNA, 9 bp, Artificial Sequence
  Synthetic nucleic acid molecule
aagtgagga

SEQ ID NO: 4056 - DNA, 9 bp, Artificial Sequence
  Synthetic nucleic acid molecule
cagtgagga

SEQ ID NO: 4057 - DNA, 9 bp, Artificial Sequence
  Synthetic nucleic acid molecule
gagtgaggg

SEQ ID NO: 4058 - DNA, 9 bp, Artificial Sequence
  Synthetic nucleic acid molecule
cagtgagga

SEQ ID NO: 4059 - DNA, 9 bp, Artificial Sequence
  Synthetic nucleic acid molecule
gagtgaggt

SEQ ID NO: 4060 - DNA, 9 bp, Artificial Sequence
  Synthetic nucleic acid molecule
gagtgaggg

SEQ ID NO: 4061 - DNA, 9 bp, Artificial Sequence
  Synthetic nucleic acid molecule
gagtgaggt

SEQ ID NO: 4062 - DNA, 9 bp, Artificial Sequence
  Synthetic nucleic acid molecule
gagtgaggc

SEQ ID NO: 4063 - DNA, 9 bp, Artificial Sequence
  Synthetic nucleic acid molecule
cagtgagga

SEQ ID NO: 4064 - DNA, 9 bp, Artificial Sequence
  Synthetic nucleic acid molecule
gagtgaggt

SEQ ID NO: 4065 - DNA, 9 bp, Artificial Sequence
  Synthetic nucleic acid molecule
gagggagga

SEQ ID NO: 4066 - DNA, 9 bp, Artificial Sequence
  Synthetic nucleic acid molecule
tagtgagga

SEQ ID NO: 4067 - DNA, 9 bp, Artificial Sequence
  Synthetic nucleic acid molecule
gagtgaggg

SEQ ID NO: 4068 - DNA, 9 bp, Artificial Sequence
  Synthetic nucleic acid molecule
gagagagga

SEQ ID NO: 4069 - DNA, 9 bp, Artificial Sequence
  Synthetic nucleic acid molecule
gagtgaggt

SEQ ID NO: 4070 - DNA, 9 bp, Artificial Sequence
  Synthetic nucleic acid molecule
gagggagga

SEQ ID NO: 4071 - DNA, 9 bp, Artificial Sequence
  Synthetic nucleic acid molecule
gagtgaggg

SEQ ID NO: 4072 - DNA, 9 bp, Artificial Sequence
  Synthetic nucleic acid molecule
gagggagga

SEQ ID NO: 4073 - DNA, 9 bp, Artificial Sequence
  Synthetic nucleic acid molecule
aagtgagga

SEQ ID NO: 4074 - DNA, 9 bp, Artificial Sequence
  Synthetic nucleic acid molecule
gagcgagga

SEQ ID NO: 4075 - DNA, 9 bp, Artificial Sequence
  Synthetic nucleic acid molecule
cagtgagga

SEQ ID NO: 4076 - DNA, 9 bp, Artificial Sequence
  Synthetic nucleic acid molecule
gagtgaggg

SEQ ID NO: 4077 - DNA, 9 bp, Artificial Sequence
  Synthetic nucleic acid molecule
aagtgagga

SEQ ID NO: 4078 - DNA, 9 bp, Artificial Sequence
  Synthetic nucleic acid molecule
gagtgaggt

SEQ ID NO: 4079 - DNA, 9 bp, Artificial Sequence
  Synthetic nucleic acid molecule
gggtgagga

SEQ ID NO: 4080 - DNA, 9 bp, Artificial Sequence
  Synthetic nucleic acid molecule
gagtgaggt

SEQ ID NO: 4081 - DNA, 9 bp, Artificial Sequence
  Synthetic nucleic acid molecule
tagtgagga

SEQ ID NO: 4082 - DNA, 9 bp, Artificial Sequence
  Synthetic nucleic acid molecule
aagtgagga

SEQ ID NO: 4083 - DNA, 9 bp, Artificial Sequence
  Synthetic nucleic acid molecule
cagtgagga

SEQ ID NO: 4084 - DNA, 9 bp, Artificial Sequence
  Synthetic nucleic acid molecule
gagtgaggg

SEQ ID NO: 4085 - DNA, 9 bp, Artificial Sequence
  Synthetic nucleic acid molecule
gagagagga

SEQ ID NO: 4086 - DNA, 9 bp, Artificial Sequence
  Synthetic nucleic acid molecule
gagtgagca

SEQ ID NO: 4087 - DNA, 9 bp, Artificial Sequence
  Synthetic nucleic acid molecule
gagtaagga

SEQ ID NO: 4088 - DNA, 9 bp, Artificial Sequence
  Synthetic nucleic acid molecule
gagtgaggc

SEQ ID NO: 4089 - DNA, 9 bp, Artificial Sequence
  Synthetic nucleic acid molecule
gagtgaaga

SEQ ID NO: 4090 - DNA, 9 bp, Artificial Sequence
  Synthetic nucleic acid molecule
gagtgaggg

SEQ ID NO: 4091 - DNA, 9 bp, Artificial Sequence
  Synthetic nucleic acid molecule
gagtaagga

SEQ ID NO: 4092 - DNA, 9 bp, Artificial Sequence
  Synthetic nucleic acid molecule
gagtgaggg

SEQ ID NO: 4093 - DNA, 9 bp, Artificial Sequence
  Synthetic nucleic acid molecule
gagtgaggt

SEQ ID NO: 4094 - DNA, 9 bp, Artificial Sequence
  Synthetic nucleic acid molecule
gagggagga

SEQ ID NO: 4095 - DNA, 9 bp, Artificial Sequence
  Synthetic nucleic acid molecule
cagtgagga

SEQ ID NO: 4096 - DNA, 9 bp, Artificial Sequence
  Synthetic nucleic acid molecule
gagtgaggg

SEQ ID NO: 4097 - DNA, 9 bp, Artificial Sequence
  Synthetic nucleic acid molecule
gagtgtgga

SEQ ID NO: 4098 - DNA, 9 bp, Artificial Sequence
  Synthetic nucleic acid molecule
gagtgaggg

SEQ ID NO: 4099 - DNA, 9 bp, Artificial Sequence
  Synthetic nucleic acid molecule
gagggagga

SEQ ID NO: 4100 - DNA, 9 bp, Artificial Sequence
  Synthetic nucleic acid molecule
gagtaagga

SEQ ID NO: 4101 - DNA, 9 bp, Artificial Sequence
  Synthetic nucleic acid molecule
aagtgagga

SEQ ID NO: 4102 - DNA, 9 bp, Artificial Sequence
  Synthetic nucleic acid molecule
gagtgaggg

SEQ ID NO: 4103 - DNA, 9 bp, Artificial Sequence
  Synthetic nucleic acid molecule
gagtgaggc

SEQ ID NO: 4104 - DNA, 9 bp, Artificial Sequence
  Synthetic nucleic acid molecule
gagtgagaa

SEQ ID NO: 4105 - DNA, 9 bp, Artificial Sequence
  Synthetic nucleic acid molecule
gagtgagta

SEQ ID NO: 4106 - DNA, 9 bp, Artificial Sequence
  Synthetic nucleic acid molecule
gagtgaggg

SEQ ID NO: 4107 - DNA, 9 bp, Artificial Sequence
  Synthetic nucleic acid molecule
gtgtgagga

SEQ ID NO: 4108 - DNA, 9 bp, Artificial Sequence
  Synthetic nucleic acid molecule
gagtgaggg

SEQ ID NO: 4109 - DNA, 9 bp, Artificial Sequence
  Synthetic nucleic acid molecule
aagtgagga

SEQ ID NO: 4110 - DNA, 9 bp, Artificial Sequence
  Synthetic nucleic acid molecule
gagtgggga

SEQ ID NO: 4111 - DNA, 9 bp, Artificial Sequence
  Synthetic nucleic acid molecule
gagtgaggg

SEQ ID NO: 4112 - DNA, 9 bp, Artificial Sequence
  Synthetic nucleic acid molecule
gagtgaggt

SEQ ID NO: 4113 - DNA, 9 bp, Artificial Sequence
  Synthetic nucleic acid molecule
gagtgaggg

SEQ ID NO: 4114 - DNA, 9 bp, Artificial Sequence
  Synthetic nucleic acid molecule
aagtgagga

SEQ ID NO: 4115 - DNA, 9 bp, Artificial Sequence
  Synthetic nucleic acid molecule
gagtgaggg

SEQ ID NO: 4116 - DNA, 9 bp, Artificial Sequence
  Synthetic nucleic acid molecule
aagtgagga

SEQ ID NO: 4117 - DNA, 9 bp, Artificial Sequence
  Synthetic nucleic acid molecule
gagtgagca

SEQ ID NO: 4118 - DNA, 9 bp, Artificial Sequence
  Synthetic nucleic acid molecule
cagtgagga

SEQ ID NO: 4119 - DNA, 9 bp, Artificial Sequence
  Synthetic nucleic acid molecule
gagtgaggc

SEQ ID NO: 4120 - DNA, 9 bp, Artificial Sequence
  Synthetic nucleic acid molecule
aagtgagga

SEQ ID NO: 4121 - DNA, 9 bp, Artificial Sequence
  Synthetic nucleic acid molecule
gagggagga

SEQ ID NO: 4122 - DNA, 9 bp, Artificial Sequence
  Synthetic nucleic acid molecule
gagtgaggc

SEQ ID NO: 4123 - DNA, 9 bp, Artificial Sequence
  Synthetic nucleic acid molecule
cagtgagga

SEQ ID NO: 4124 - DNA, 9 bp, Artificial Sequence
  Synthetic nucleic acid molecule
tagtgagga

SEQ ID NO: 4125 - DNA, 9 bp, Artificial Sequence
  Synthetic nucleic acid molecule
gagtgaggg

SEQ ID NO: 4126 - DNA, 9 bp, Artificial Sequence
  Synthetic nucleic acid molecule
gagtgaggt

SEQ ID NO: 4127 - DNA, 9 bp, Artificial Sequence
  Synthetic nucleic acid molecule
gagtgagaa

SEQ ID NO: 4128 - DNA, 9 bp, Artificial Sequence
  Synthetic nucleic acid molecule
gagtgaggg

SEQ ID NO: 4129 - DNA, 9 bp, Artificial Sequence
  Synthetic nucleic acid molecule
gagagagga

SEQ ID NO: 4130 - DNA, 9 bp, Artificial Sequence
  Synthetic nucleic acid molecule
aagtgagga

SEQ ID NO: 4131 - DNA, 9 bp, Artificial Sequence
  Synthetic nucleic acid molecule
gagtgaggg

SEQ ID NO: 4132 - DNA, 9 bp, Artificial Sequence
  Synthetic nucleic acid molecule
aagtgagga

SEQ ID NO: 4133 - DNA, 9 bp, Artificial Sequence
  Synthetic nucleic acid molecule
aagtgagga

SEQ ID NO: 4134 - DNA, 9 bp, Artificial Sequence
  Synthetic nucleic acid molecule
gagtgaggt

SEQ ID NO: 4135 - DNA, 9 bp, Artificial Sequence
  Synthetic nucleic acid molecule
gagtgaggt

SEQ ID NO: 4136 - DNA, 9 bp, Artificial Sequence
  Synthetic nucleic acid molecule
cagtgagga

SEQ ID NO: 4137 - DNA, 9 bp, Artificial Sequence
  Synthetic nucleic acid molecule
gagtgaggc

SEQ ID NO: 4138 - DNA, 9 bp, Artificial Sequence
  Synthetic nucleic acid molecule
gtgtgagga

SEQ ID NO: 4139 - DNA, 9 bp, Artificial Sequence
  Synthetic nucleic acid molecule
gagtgaggg

SEQ ID NO: 4140 - DNA, 9 bp, Artificial Sequence
  Synthetic nucleic acid molecule
aagtgagga

SEQ ID NO: 4141 - DNA, 9 bp, Artificial Sequence
  Synthetic nucleic acid molecule
gaatgagga

SEQ ID NO: 4142 - DNA, 9 bp, Artificial Sequence
  Synthetic nucleic acid molecule
gagcgagga

SEQ ID NO: 4143 - DNA, 9 bp, Artificial Sequence
  Synthetic nucleic acid molecule
gagagagga

SEQ ID NO: 4144 - DNA, 9 bp, Artificial Sequence
  Synthetic nucleic acid molecule
gagtgaggc

SEQ ID NO: 4145 - DNA, 9 bp, Artificial Sequence
  Synthetic nucleic acid molecule
gagtgaggt

SEQ ID NO: 4146 - DNA, 9 bp, Artificial Sequence
  Synthetic nucleic acid molecule
gagtgaggc

SEQ ID NO: 4147 - DNA, 9 bp, Artificial Sequence
  Synthetic nucleic acid molecule
aagtgagga

SEQ ID NO: 4148 - DNA, 9 bp, Artificial Sequence
  Synthetic nucleic acid molecule
aagtgagga

SEQ ID NO: 4149 - DNA, 9 bp, Artificial Sequence
  Synthetic nucleic acid molecule
aagtgagga

SEQ ID NO: 4150 - DNA, 9 bp, Artificial Sequence
  Synthetic nucleic acid molecule
gagtgaggc

SEQ ID NO: 4151 - DNA, 9 bp, Artificial Sequence
  Synthetic nucleic acid molecule
gagtgaggg

SEQ ID NO: 4152 - DNA, 9 bp, Artificial Sequence
  Synthetic nucleic acid molecule
gagtgaggc

SEQ ID NO: 4153 - DNA, 9 bp, Artificial Sequence
  Synthetic nucleic acid molecule
gagtgagaa

SEQ ID NO: 4154 - DNA, 9 bp, Artificial Sequence
  Synthetic nucleic acid molecule
gagtgaggt

SEQ ID NO: 4155 - DNA, 9 bp, Artificial Sequence
  Synthetic nucleic acid molecule
gagtgaggg

SEQ ID NO: 4156 - DNA, 9 bp, Artificial Sequence
  Synthetic nucleic acid molecule
gagtgaggc

SEQ ID NO: 4157 - DNA, 9 bp, Artificial Sequence
  Synthetic nucleic acid molecule
gagtgtgga

SEQ ID NO: 4158 - DNA, 9 bp, Artificial Sequence
  Synthetic nucleic acid molecule
gagtgaggg

SEQ ID NO: 4159 - DNA, 9 bp, Artificial Sequence
  Synthetic nucleic acid molecule
gagtgaggt

SEQ ID NO: 4160 - DNA, 9 bp, Artificial Sequence
  Synthetic nucleic acid molecule
aagtgagga

SEQ ID NO: 4161 - DNA, 9 bp, Artificial Sequence
  Synthetic nucleic acid molecule
gagtgaggc

SEQ ID NO: 4162 - DNA, 9 bp, Artificial Sequence
  Synthetic nucleic acid molecule
gagtgaggt

SEQ ID NO: 4163 - DNA, 9 bp, Artificial Sequence
  Synthetic nucleic acid molecule
gagtgaggg

SEQ ID NO: 4164 - DNA, 9 bp, Artificial Sequence
  Synthetic nucleic acid molecule
gagtgaggg

SEQ ID NO: 4165 - DNA, 9 bp, Artificial Sequence
  Synthetic nucleic acid molecule
gagtgagca

SEQ ID NO: 4166 - DNA, 9 bp, Artificial Sequence
  Synthetic nucleic acid molecule
gagtgaggt

SEQ ID NO: 4167 - DNA, 9 bp, Artificial Sequence
  Synthetic nucleic acid molecule
gagtgaaga

SEQ ID NO: 4168 - DNA, 9 bp, Artificial Sequence
  Synthetic nucleic acid molecule
gagtgaggc

SEQ ID NO: 4169 - DNA, 9 bp, Artificial Sequence
  Synthetic nucleic acid molecule
cagtgagga

SEQ ID NO: 4170 - DNA, 9 bp, Artificial Sequence
  Synthetic nucleic acid molecule
gagtgaggc

SEQ ID NO: 4171 - DNA, 9 bp, Artificial Sequence
  Synthetic nucleic acid molecule
gagggagga

SEQ ID NO: 4172 - DNA, 9 bp, Artificial Sequence
  Synthetic nucleic acid molecule
gagtgagaa

SEQ ID NO: 4173 - DNA, 9 bp, Artificial Sequence
  Synthetic nucleic acid molecule
gagggagga

SEQ ID NO: 4174 - DNA, 9 bp, Artificial Sequence
  Synthetic nucleic acid molecule
aagtgagga

SEQ ID NO: 4175 - DNA, 9 bp, Artificial Sequence
  Synthetic nucleic acid molecule
tagtgagga

SEQ ID NO: 4176 - DNA, 9 bp, Artificial Sequence
  Synthetic nucleic acid molecule
gagtgagca

SEQ ID NO: 4177 - DNA, 9 bp, Artificial Sequence
  Synthetic nucleic acid molecule
gagggagga

SEQ ID NO: 4178 - DNA, 9 bp, Artificial Sequence
  Synthetic nucleic acid molecule
gagtgaggg

SEQ ID NO: 4179 - DNA, 9 bp, Artificial Sequence
  Synthetic nucleic acid molecule
gagtgaggg

SEQ ID NO: 4180 - DNA, 9 bp, Artificial Sequence
  Synthetic nucleic acid molecule
gagtgaggc

SEQ ID NO: 4181 - DNA, 9 bp, Artificial Sequence
  Synthetic nucleic acid molecule
aagtgagga

SEQ ID NO: 4182 - DNA, 9 bp, Artificial Sequence
  Synthetic nucleic acid molecule
gagtgaggg

SEQ ID NO: 4183 - DNA, 9 bp, Artificial Sequence
  Synthetic nucleic acid molecule
aagtgagga

SEQ ID NO: 4184 - DNA, 9 bp, Artificial Sequence
  Synthetic nucleic acid molecule
gagtgaggg

SEQ ID NO: 4185 - DNA, 9 bp, Artificial Sequence
  Synthetic nucleic acid molecule
gagtgaggg

SEQ ID NO: 4186 - DNA, 9 bp, Artificial Sequence
  Synthetic nucleic acid molecule
gagtgaggg

SEQ ID NO: 4187 - DNA, 9 bp, Artificial Sequence
  Synthetic nucleic acid molecule
gagtgaggg

SEQ ID NO: 4188 - DNA, 9 bp, Artificial Sequence
  Synthetic nucleic acid molecule
gagtgaggg

SEQ ID NO: 4189 - DNA, 9 bp, Artificial Sequence
  Synthetic nucleic acid molecule
gagtgaggg

SEQ ID NO: 4190 - DNA, 9 bp, Artificial Sequence
  Synthetic nucleic acid molecule
aagtgagga

SEQ ID NO: 4191 - DNA, 9 bp, Artificial Sequence
  Synthetic nucleic acid molecule
aagtgagga

SEQ ID NO: 4192 - DNA, 9 bp, Artificial Sequence
  Synthetic nucleic acid molecule
gagtgagaa

SEQ ID NO: 4193 - DNA, 9 bp, Artificial Sequence
  Synthetic nucleic acid molecule
gagtgaggg

SEQ ID NO: 4194 - DNA, 9 bp, Artificial Sequence
  Synthetic nucleic acid molecule
gagtgagaa

SEQ ID NO: 4195 - DNA, 9 bp, Artificial Sequence
  Synthetic nucleic acid molecule
gagtgaggg

SEQ ID NO: 4196 - DNA, 9 bp, Artificial Sequence
  Synthetic nucleic acid molecule
gagtgaggg

SEQ ID NO: 4197 - DNA, 9 bp, Artificial Sequence
  Synthetic nucleic acid molecule
aagtgagga

SEQ ID NO: 4198 - DNA, 9 bp, Artificial Sequence
  Synthetic nucleic acid molecule
gagtgaggc

SEQ ID NO: 4199 - DNA, 9 bp, Artificial Sequence
  Synthetic nucleic acid molecule
gagtgaggt

SEQ ID NO: 4200 - DNA, 9 bp, Artificial Sequence
  Synthetic nucleic acid molecule
gagtgaggc

SEQ ID NO: 4201 - DNA, 9 bp, Artificial Sequence
  Synthetic nucleic acid molecule
cagtgagga

SEQ ID NO: 4202 - DNA, 9 bp, Artificial Sequence
  Synthetic nucleic acid molecule
tagtgagga

SEQ ID NO: 4203 - DNA, 9 bp, Artificial Sequence
  Synthetic nucleic acid molecule
gagagagga

SEQ ID NO: 4204 - DNA, 9 bp, Artificial Sequence
  Synthetic nucleic acid molecule
gagtgaggg

SEQ ID NO: 4205 - DNA, 9 bp, Artificial Sequence
  Synthetic nucleic acid molecule
gagtgaggg

SEQ ID NO: 4206 - DNA, 9 bp, Artificial Sequence
  Synthetic nucleic acid molecule
gagggagga

SEQ ID NO: 4207 - DNA, 9 bp, Artificial Sequence
  Synthetic nucleic acid molecule
cagtgagga

SEQ ID NO: 4208 - DNA, 9 bp, Artificial Sequence
  Synthetic nucleic acid molecule
gagtgaggg

SEQ ID NO: 4209 - DNA, 9 bp, Artificial Sequence
  Synthetic nucleic acid molecule
gagtgaggc

SEQ ID NO: 4210 - DNA, 9 bp, Artificial Sequence
  Synthetic nucleic acid molecule
gagggagga

SEQ ID NO: 4211 - DNA, 9 bp, Artificial Sequence
  Synthetic nucleic acid molecule
gagtgaggt

SEQ ID NO: 4212 - DNA, 9 bp, Artificial Sequence
  Synthetic nucleic acid molecule
aagtgagga

SEQ ID NO: 4213 - DNA, 9 bp, Artificial Sequence
  Synthetic nucleic acid molecule
gagtgaggg

SEQ ID NO: 4214 - DNA, 9 bp, Artificial Sequence
  Synthetic nucleic acid molecule
gagtgaggg

SEQ ID NO: 4215 - DNA, 9 bp, Artificial Sequence
  Synthetic nucleic acid molecule
aagtgagga

SEQ ID NO: 4216 - DNA, 9 bp, Artificial Sequence
  Synthetic nucleic acid molecule
gagtgagaa

SEQ ID NO: 4217 - DNA, 9 bp, Artificial Sequence
  Synthetic nucleic acid molecule
gagtgaggt

SEQ ID NO: 4218 - DNA, 9 bp, Artificial Sequence
  Synthetic nucleic acid molecule
gagagagga

SEQ ID NO: 4219 - DNA, 9 bp, Artificial Sequence
  Synthetic nucleic acid molecule
gagtgaggg

SEQ ID NO: 4220 - DNA, 9 bp, Artificial Sequence
  Synthetic nucleic acid molecule
gagtgagaa

SEQ ID NO: 4221 - DNA, 9 bp, Artificial Sequence
  Synthetic nucleic acid molecule
cagtgagga

SEQ ID NO: 4222 - DNA, 9 bp, Artificial Sequence
  Synthetic nucleic acid molecule
cagtgagga

SEQ ID NO: 4223 - DNA, 9 bp, Artificial Sequence
  Synthetic nucleic acid molecule
gagtgaggt

SEQ ID NO: 4224 - DNA, 9 bp, Artificial Sequence
  Synthetic nucleic acid molecule
gagtgaggg

SEQ ID NO: 4225 - DNA, 9 bp, Artificial Sequence
  Synthetic nucleic acid molecule
gagtgaggg

SEQ ID NO: 4226 - DNA, 9 bp, Artificial Sequence
  Synthetic nucleic acid molecule
gagtgaggg

SEQ ID NO: 4227 - DNA, 9 bp, Artificial Sequence
  Synthetic nucleic acid molecule
gagtgaggc

SEQ ID NO: 4228 - DNA, 9 bp, Artificial Sequence
  Synthetic nucleic acid molecule
gagtgaggc

SEQ ID NO: 4229 - DNA, 9 bp, Artificial Sequence
  Synthetic nucleic acid molecule
gagggagga

SEQ ID NO: 4230 - DNA, 9 bp, Artificial Sequence
  Synthetic nucleic acid molecule
gagtgaggg

SEQ ID NO: 4231 - DNA, 9 bp, Artificial Sequence
  Synthetic nucleic acid molecule
gggtgagga

SEQ ID NO: 4232 - DNA, 9 bp, Artificial Sequence
  Synthetic nucleic acid molecule
gagtgggga

SEQ ID NO: 4233 - DNA, 9 bp, Artificial Sequence
  Synthetic nucleic acid molecule
gagtgaggc

SEQ ID NO: 4234 - DNA, 9 bp, Artificial Sequence
  Synthetic nucleic acid molecule
gagtgagca

SEQ ID NO: 4235 - DNA, 9 bp, Artificial Sequence
  Synthetic nucleic acid molecule
gagtgagaa

SEQ ID NO: 4236 - DNA, 9 bp, Artificial Sequence
  Synthetic nucleic acid molecule
gagtgaggc

SEQ ID NO: 4237 - DNA, 9 bp, Artificial Sequence
  Synthetic nucleic acid molecule
gagtgaggt

SEQ ID NO: 4238 - DNA, 9 bp, Artificial Sequence
  Synthetic nucleic acid molecule
gagtgagga

SEQ ID NO: 4239 - DNA, 9 bp, Artificial Sequence
  Synthetic nucleic acid molecule
gagtgagga

SEQ ID NO: 4240 - DNA, 9 bp, Artificial Sequence
  Synthetic nucleic acid molecule
gagtgagga

SEQ ID NO: 4241 - DNA, 9 bp, Artificial Sequence
  Synthetic nucleic acid molecule
gagtgagga

SEQ ID NO: 4242 - DNA, 9 bp, Artificial Sequence
  Synthetic nucleic acid molecule
gagtgagga

SEQ ID NO: 4243 - DNA, 9 bp, Artificial Sequence
  Synthetic nucleic acid molecule
gagtgagga

SEQ ID NO: 4244 - DNA, 9 bp, Artificial Sequence
  Synthetic nucleic acid molecule
gagtgagga

SEQ ID NO: 4245 - DNA, 9 bp, Artificial Sequence
  Synthetic nucleic acid molecule
gagtgagga

SEQ ID NO: 4246 - DNA, 9 bp, Artificial Sequence
  Synthetic nucleic acid molecule
gagtgagga

SEQ ID NO: 4247 - DNA, 9 bp, Artificial Sequence
  Synthetic nucleic acid molecule
gagtgagga

SEQ ID NO: 4248 - DNA, 9 bp, Artificial Sequence
  Synthetic nucleic acid molecule
gagtgagga

SEQ ID NO: 4249 - DNA, 9 bp, Artificial Sequence
  Synthetic nucleic acid molecule
gagtgagga

SEQ ID NO: 4250 - DNA, 9 bp, Artificial Sequence
  Synthetic nucleic acid molecule
gagtgagga

SEQ ID NO: 4251 - DNA, 9 bp, Artificial Sequence
  Synthetic nucleic acid molecule
gagtgagga

SEQ ID NO: 4252 - DNA, 9 bp, Artificial Sequence
  Synthetic nucleic acid molecule
gagtgagga

SEQ ID NO: 4253 - DNA, 9 bp, Artificial Sequence
  Synthetic nucleic acid molecule
gagtgagga

SEQ ID NO: 4254 - DNA, 9 bp, Artificial Sequence
  Synthetic nucleic acid molecule
gagtgagga

SEQ ID NO: 4255 - DNA, 9 bp, Artificial Sequence
  Synthetic nucleic acid molecule
gagtgagga

SEQ ID NO: 4256 - DNA, 9 bp, Artificial Sequence
  Synthetic nucleic acid molecule
gagtgagga

SEQ ID NO: 4257 - DNA, 9 bp, Artificial Sequence
  Synthetic nucleic acid molecule
gagtgagga

SEQ ID NO: 4258 - DNA, 9 bp, Artificial Sequence
  Synthetic nucleic acid molecule
gagtgagga

SEQ ID NO: 4259 - DNA, 9 bp, Artificial Sequence
  Synthetic nucleic acid molecule
gagtgagga

SEQ ID NO: 4260 - DNA, 9 bp, Artificial Sequence
  Synthetic nucleic acid molecule
gagtgagga

SEQ ID NO: 4261 - DNA, 9 bp, Artificial Sequence
  Synthetic nucleic acid molecule
gagtgagga

SEQ ID NO: 4262 - DNA, 9 bp, Artificial Sequence
  Synthetic nucleic acid molecule
gagtgagga

SEQ ID NO: 4263 - DNA, 9 bp, Artificial Sequence
  Synthetic nucleic acid molecule
gagtgagga

SEQ ID NO: 4264 - DNA, 9 bp, Artificial Sequence
  Synthetic nucleic acid molecule
gagtgagga

SEQ ID NO: 4265 - DNA, 9 bp, Artificial Sequence
  Synthetic nucleic acid molecule
gagtgagga

SEQ ID NO: 4266 - DNA, 9 bp, Artificial Sequence
  Synthetic nucleic acid molecule
gagtgagga

SEQ ID NO: 4267 - DNA, 9 bp, Artificial Sequence
  Synthetic nucleic acid molecule
gagtgagga

SEQ ID NO: 4268 - DNA, 9 bp, Artificial Sequence
  Synthetic nucleic acid molecule
gagtgagga

SEQ ID NO: 4269 - DNA, 9 bp, Artificial Sequence
  Synthetic nucleic acid molecule
gagtgagga

SEQ ID NO: 4270 - DNA, 9 bp, Artificial Sequence
  Synthetic nucleic acid molecule
gagtgagga

SEQ ID NO: 4271 - DNA, 9 bp, Artificial Sequence
  Synthetic nucleic acid molecule
gagtgagga

SEQ ID NO: 4272 - DNA, 9 bp, Artificial Sequence
  Synthetic nucleic acid molecule
gagtgagga

SEQ ID NO: 4273 - DNA, 9 bp, Artificial Sequence
  Synthetic nucleic acid molecule
gagtgagga

SEQ ID NO: 4274 - DNA, 9 bp, Artificial Sequence
  Synthetic nucleic acid molecule
gagtgagga

SEQ ID NO: 4275 - DNA, 9 bp, Artificial Sequence
  Synthetic nucleic acid molecule
gagtgagga

SEQ ID NO: 4276 - DNA, 9 bp, Artificial Sequence
  Synthetic nucleic acid molecule
gagtgagga

SEQ ID NO: 4277 - DNA, 9 bp, Artificial Sequence
  Synthetic nucleic acid molecule
gagtgagga

SEQ ID NO: 4278 - DNA, 9 bp, Artificial Sequence
  Synthetic nucleic acid molecule
gagtgagga

SEQ ID NO: 4279 - DNA, 9 bp, Artificial Sequence
  Synthetic nucleic acid molecule
gagtgagga

SEQ ID NO: 4280 - DNA, 9 bp, Artificial Sequence
  Synthetic nucleic acid molecule
gagtgagga

SEQ ID NO: 4281 - DNA, 9 bp, Artificial Sequence
  Synthetic nucleic acid molecule
gagtgagga

SEQ ID NO: 4282 - DNA, 9 bp, Artificial Sequence
  Synthetic nucleic acid molecule
gagtgagga

SEQ ID NO: 4283 - DNA, 9 bp, Artificial Sequence
  Synthetic nucleic acid molecule
gagtgagga

SEQ ID NO: 4284 - DNA, 9 bp, Artificial Sequence
  Synthetic nucleic acid molecule
gagtgagga

SEQ ID NO: 4285 - DNA, 9 bp, Artificial Sequence
  Synthetic nucleic acid molecule
gagtgagga

SEQ ID NO: 4286 - DNA, 9 bp, Artificial Sequence
  Synthetic nucleic acid molecule
gagtgagga

SEQ ID NO: 4287 - DNA, 9 bp, Artificial Sequence
  Synthetic nucleic acid molecule
gagtgagga

SEQ ID NO: 4288 - DNA, 9 bp, Artificial Sequence
  Synthetic nucleic acid molecule
gagtgagga

SEQ ID NO: 4289 - DNA, 9 bp, Artificial Sequence
  Synthetic nucleic acid molecule
gagtgagga

SEQ ID NO: 4290 - DNA, 9 bp, Artificial Sequence
  Synthetic nucleic acid molecule
gagtgagga

SEQ ID NO: 4291 - DNA, 9 bp, Artificial Sequence
  Synthetic nucleic acid molecule
gagtgagga

SEQ ID NO: 4292 - DNA, 9 bp, Artificial Sequence
  Synthetic nucleic acid molecule
gagtgagga

SEQ ID NO: 4293 - DNA, 9 bp, Artificial Sequence
  Synthetic nucleic acid molecule
gagtgagga

SEQ ID NO: 4294 - DNA, 9 bp, Artificial Sequence
  Synthetic nucleic acid molecule
gagtgagga

SEQ ID NO: 4295 - DNA, 9 bp, Artificial Sequence
  Synthetic nucleic acid molecule
gagtgagga

SEQ ID NO: 4296 - DNA, 9 bp, Artificial Sequence
  Synthetic nucleic acid molecule
gagtgagga

SEQ ID NO: 4297 - DNA, 9 bp, Artificial Sequence
  Synthetic nucleic acid molecule
gagtgagga

SEQ ID NO: 4298 - DNA, 9 bp, Artificial Sequence
  Synthetic nucleic acid molecule
gagtgagga

SEQ ID NO: 4299 - DNA, 9 bp, Artificial Sequence
  Synthetic nucleic acid molecule
gagtgagga

SEQ ID NO: 4300 - DNA, 9 bp, Artificial Sequence
  Synthetic nucleic acid molecule
gagtgagga

SEQ ID NO: 4301 - DNA, 9 bp, Artificial Sequence
  Synthetic nucleic acid molecule
gagtgagga

SEQ ID NO: 4302 - DNA, 9 bp, Artificial Sequence
  Synthetic nucleic acid molecule
gagtgagga

SEQ ID NO: 4303 - DNA, 9 bp, Artificial Sequence
  Synthetic nucleic acid molecule
gagtgagga

SEQ ID NO: 4304 - DNA, 9 bp, Artificial Sequence
  Synthetic nucleic acid molecule
gagtgagga

SEQ ID NO: 4305 - DNA, 9 bp, Artificial Sequence
  Synthetic nucleic acid molecule
gagtgagga

SEQ ID NO: 4306 - DNA, 9 bp, Artificial Sequence
  Synthetic nucleic acid molecule
gagtgagga

SEQ ID NO: 4307 - DNA, 9 bp, Artificial Sequence
  Synthetic nucleic acid molecule
gagtgagga

SEQ ID NO: 4308 - DNA, 9 bp, Artificial Sequence
  Synthetic nucleic acid molecule
gagtgagga

SEQ ID NO: 4309 - DNA, 9 bp, Artificial Sequence
  Synthetic nucleic acid molecule
gagtgagga

SEQ ID NO: 4310 - DNA, 9 bp, Artificial Sequence
  Synthetic nucleic acid molecule
gagtgagga

SEQ ID NO: 4311 - DNA, 9 bp, Artificial Sequence
  Synthetic nucleic acid molecule
gagtgagga

SEQ ID NO: 4312 - DNA, 9 bp, Artificial Sequence
  Synthetic nucleic acid molecule
gagtgagga

SEQ ID NO: 4313 - DNA, 9 bp, Artificial Sequence
  Synthetic nucleic acid molecule
gagtgagga

SEQ ID NO: 4314 - DNA, 9 bp, Artificial Sequence
  Synthetic nucleic acid molecule
gagtgagga

SEQ ID NO: 4315 - DNA, 9 bp, Artificial Sequence
  Synthetic nucleic acid molecule
gagtgagga

SEQ ID NO: 4316 - DNA, 9 bp, Artificial Sequence
  Synthetic nucleic acid molecule
gagtgagga

SEQ ID NO: 4317 - DNA, 9 bp, Artificial Sequence
  Synthetic nucleic acid molecule
gagtgagga

SEQ ID NO: 4318 - DNA, 9 bp, Artificial Sequence
  Synthetic nucleic acid molecule
gagtgagga

SEQ ID NO: 4319 - DNA, 9 bp, Artificial Sequence
  Synthetic nucleic acid molecule
gagtgagga

SEQ ID NO: 4320 - DNA, 9 bp, Artificial Sequence
  Synthetic nucleic acid molecule
gagtgagga

SEQ ID NO: 4321 - DNA, 9 bp, Artificial Sequence
  Synthetic nucleic acid molecule
gagtgagga

SEQ ID NO: 4322 - DNA, 9 bp, Artificial Sequence
  Synthetic nucleic acid molecule
gagtgagga

SEQ ID NO: 4323 - DNA, 9 bp, Artificial Sequence
  Synthetic nucleic acid molecule
gagtgagga

SEQ ID NO: 4324 - DNA, 9 bp, Artificial Sequence
  Synthetic nucleic acid molecule
gagtgagga

SEQ ID NO: 4325 - DNA, 9 bp, Artificial Sequence
  Synthetic nucleic acid molecule
gagtgagga

SEQ ID NO: 4326 - DNA, 9 bp, Artificial Sequence
  Synthetic nucleic acid molecule
gagtgagga

SEQ ID NO: 4327 - DNA, 9 bp, Artificial Sequence
  Synthetic nucleic acid molecule
gagtgagga

SEQ ID NO: 4328 - DNA, 9 bp, Artificial Sequence
  Synthetic nucleic acid molecule
gagtgagga

SEQ ID NO: 4329 - DNA, 9 bp, Artificial Sequence
  Synthetic nucleic acid molecule
gagtgagga

SEQ ID NO: 4330 - DNA, 9 bp, Artificial Sequence
  Synthetic nucleic acid molecule
gagtgagga

SEQ ID NO: 4331 - DNA, 9 bp, Artificial Sequence
  Synthetic nucleic acid molecule
gagtgagga

SEQ ID NO: 4332 - DNA, 9 bp, Artificial Sequence
  Synthetic nucleic acid molecule
gagtgagga

SEQ ID NO: 4333 - DNA, 9 bp, Artificial Sequence
  Synthetic nucleic acid molecule
gagtgagga

SEQ ID NO: 4334 - DNA, 9 bp, Artificial Sequence
  Synthetic nucleic acid molecule
gagtgagga

SEQ ID NO: 4335 - DNA, 9 bp, Artificial Sequence
  Synthetic nucleic acid molecule
gagtgagga

SEQ ID NO: 4336 - DNA, 9 bp, Artificial Sequence
  Synthetic nucleic acid molecule
gagtgagga

SEQ ID NO: 4337 - DNA, 9 bp, Artificial Sequence
  Synthetic nucleic acid molecule
gagtgagga

SEQ ID NO: 4338 - DNA, 9 bp, Artificial Sequence
  Synthetic nucleic acid molecule
gagtgagga

SEQ ID NO: 4339 - DNA, 9 bp, Artificial Sequence
  Synthetic nucleic acid molecule
gagtgagga

SEQ ID NO: 4340 - DNA, 9 bp, Artificial Sequence
  Synthetic nucleic acid molecule
gagtgagga

SEQ ID NO: 4341 - DNA, 9 bp, Artificial Sequence
  Synthetic nucleic acid molecule
gagtgagga

SEQ ID NO: 4342 - DNA, 9 bp, Artificial Sequence
  Synthetic nucleic acid molecule
gagtgagga

SEQ ID NO: 4343 - DNA, 9 bp, Artificial Sequence
  Synthetic nucleic acid molecule
gagtgagga

SEQ ID NO: 4344 - DNA, 9 bp, Artificial Sequence
  Synthetic nucleic acid molecule
gagtgagga

SEQ ID NO: 4345 - DNA, 9 bp, Artificial Sequence
  Synthetic nucleic acid molecule
gagtgagga

SEQ ID NO: 4346 - DNA, 9 bp, Artificial Sequence
  Synthetic nucleic acid molecule
gagtgagga

SEQ ID NO: 4347 - DNA, 9 bp, Artificial Sequence
  Synthetic nucleic acid molecule
gagtgagga

SEQ ID NO: 4348 - DNA, 9 bp, Artificial Sequence
  Synthetic nucleic acid molecule
gagtgagga

SEQ ID NO: 4349 - DNA, 9 bp, Artificial Sequence
  Synthetic nucleic acid molecule
gagtgagga

SEQ ID NO: 4350 - DNA, 9 bp, Artificial Sequence
  Synthetic nucleic acid molecule
tagcaaggt

SEQ ID NO: 4351 - DNA, 9 bp, Artificial Sequence
  Synthetic nucleic acid molecule
gagacaagt

SEQ ID NO: 4352 - DNA, 9 bp, Artificial Sequence
  Synthetic nucleic acid molecule
gagaggcgc

SEQ ID NO: 4353 - DNA, 9 bp, Artificial Sequence
  Synthetic nucleic acid molecule
gggtgagtc

SEQ ID NO: 4354 - DNA, 9 bp, Artificial Sequence
  Synthetic nucleic acid molecule
gagaaaggt

SEQ ID NO: 4355 - DNA, 9 bp, Artificial Sequence
  Synthetic nucleic acid molecule
tggggagga

SEQ ID NO: 4356 - DNA, 9 bp, Artificial Sequence
  Synthetic nucleic acid molecule
aagtgtggg

SEQ ID NO: 4357 - DNA, 9 bp, Artificial Sequence
  Synthetic nucleic acid molecule
gtgtaaggc

SEQ ID NO: 4358 - DNA, 9 bp, Artificial Sequence
  Synthetic nucleic acid molecule
gagtcacgc

SEQ ID NO: 4359 - DNA, 9 bp, Artificial Sequence
  Synthetic nucleic acid molecule
gtgtgtgaa

SEQ ID NO: 4360 - DNA, 9 bp, Artificial Sequence
  Synthetic nucleic acid molecule
gtgtgtgaa

SEQ ID NO: 4361 - DNA, 9 bp, Artificial Sequence
  Synthetic nucleic acid molecule
aagtgtggc

SEQ ID NO: 4362 - DNA, 9 bp, Artificial Sequence
  Synthetic nucleic acid molecule
aggtgagca

SEQ ID NO: 4363 - DNA, 9 bp, Artificial Sequence
  Synthetic nucleic acid molecule
gtgtgagtc

SEQ ID NO: 4364 - DNA, 9 bp, Artificial Sequence
  Synthetic nucleic acid molecule
tagtgaata

SEQ ID NO: 4365 - DNA, 9 bp, Artificial Sequence
  Synthetic nucleic acid molecule
gtgcgatga

SEQ ID NO: 4366 - DNA, 9 bp, Artificial Sequence
  Synthetic nucleic acid molecule
gagtgttgc

SEQ ID NO: 4367 - DNA, 9 bp, Artificial Sequence
  Synthetic nucleic acid molecule
atgtgaggc

SEQ ID NO: 4368 - DNA, 9 bp, Artificial Sequence
  Synthetic nucleic acid molecule
gagtgacag

SEQ ID NO: 4369 - DNA, 9 bp, Artificial Sequence
  Synthetic nucleic acid molecule
gtgtgcggt

SEQ ID NO: 4370 - DNA, 9 bp, Artificial Sequence
  Synthetic nucleic acid molecule
aagtgtggc

SEQ ID NO: 4371 - DNA, 9 bp, Artificial Sequence
  Synthetic nucleic acid molecule
gagtaaggc

SEQ ID NO: 4372 - DNA, 9 bp, Artificial Sequence
  Synthetic nucleic acid molecule
gagtgagac

SEQ ID NO: 4373 - DNA, 9 bp, Artificial Sequence
  Synthetic nucleic acid molecule
gagtgagtc

SEQ ID NO: 4374 - DNA, 9 bp, Artificial Sequence
  Synthetic nucleic acid molecule
tagtgaggg

SEQ ID NO: 4375 - DNA, 9 bp, Artificial Sequence
  Synthetic nucleic acid molecule
tagtgaggg

SEQ ID NO: 4376 - DNA, 9 bp, Artificial Sequence
  Synthetic nucleic acid molecule
gagtgagag

SEQ ID NO: 4377 - DNA, 9 bp, Artificial Sequence
  Synthetic nucleic acid molecule
tagtgaggg

SEQ ID NO: 4378 - DNA, 9 bp, Artificial Sequence
  Synthetic nucleic acid molecule
gagtgagag

SEQ ID NO: 4379 - DNA, 9 bp, Artificial Sequence
  Synthetic nucleic acid molecule
tagtgaggg

SEQ ID NO: 4380 - DNA, 9 bp, Artificial Sequence
  Synthetic nucleic acid molecule
tagtgaggg

SEQ ID NO: 4381 - DNA, 9 bp, Artificial Sequence
  Synthetic nucleic acid molecule
gagtgagag

SEQ ID NO: 4382 - DNA, 9 bp, Artificial Sequence
  Synthetic nucleic acid molecule
gagtgagag

SEQ ID NO: 4383 - DNA, 9 bp, Artificial Sequence
  Synthetic nucleic acid molecule
gtgtgaggc

SEQ ID NO: 4384 - DNA, 9 bp, Artificial Sequence
  Synthetic nucleic acid molecule
tagtgaggg

SEQ ID NO: 4385 - DNA, 9 bp, Artificial Sequence
  Synthetic nucleic acid molecule
aagtgaggg

SEQ ID NO: 4386 - DNA, 9 bp, Artificial Sequence
  Synthetic nucleic acid molecule
gagtgagtg

SEQ ID NO: 4387 - DNA, 9 bp, Artificial Sequence
  Synthetic nucleic acid molecule
ttgtgagga

SEQ ID NO: 4388 - DNA, 9 bp, Artificial Sequence
  Synthetic nucleic acid molecule
tagtgaggg

SEQ ID NO: 4389 - DNA, 9 bp, Artificial Sequence
  Synthetic nucleic acid molecule
aagtgaggg

SEQ ID NO: 4390 - DNA, 9 bp, Artificial Sequence
  Synthetic nucleic acid molecule
gagtgagag

SEQ ID NO: 4391 - DNA, 9 bp, Artificial Sequence
  Synthetic nucleic acid molecule
tagtgaggg

SEQ ID NO: 4392 - DNA, 9 bp, Artificial Sequence
  Synthetic nucleic acid molecule
tagtgaggg

SEQ ID NO: 4393 - DNA, 9 bp, Artificial Sequence
  Synthetic nucleic acid molecule
gagtgagtc

SEQ ID NO: 4394 - DNA, 9 bp, Artificial Sequence
  Synthetic nucleic acid molecule
gagtgagtc

SEQ ID NO: 4395 - DNA, 9 bp, Artificial Sequence
  Synthetic nucleic acid molecule
gagtgagac

SEQ ID NO: 4396 - DNA, 9 bp, Artificial Sequence
  Synthetic nucleic acid molecule
tagtgaggg

SEQ ID NO: 4397 - DNA, 9 bp, Artificial Sequence
  Synthetic nucleic acid molecule
gagtgagtc

SEQ ID NO: 4398 - DNA, 9 bp, Artificial Sequence
  Synthetic nucleic acid molecule
tagtgaggt

SEQ ID NO: 4399 - DNA, 9 bp, Artificial Sequence
  Synthetic nucleic acid molecule
gagtaaggg

SEQ ID NO: 4400 - DNA, 9 bp, Artificial Sequence
  Synthetic nucleic acid molecule
aagtgaggt

SEQ ID NO: 4401 - DNA, 9 bp, Artificial Sequence
  Synthetic nucleic acid molecule
gagtgagtc

SEQ ID NO: 4402 - DNA, 9 bp, Artificial Sequence
  Synthetic nucleic acid molecule
gagtgagag

SEQ ID NO: 4403 - DNA, 9 bp, Artificial Sequence
  Synthetic nucleic acid molecule
aagtgaggc

SEQ ID NO: 4404 - DNA, 9 bp, Artificial Sequence
  Synthetic nucleic acid molecule
tagtgaggg

SEQ ID NO: 4405 - DNA, 9 bp, Artificial Sequence
  Synthetic nucleic acid molecule
aagtgaggg

SEQ ID NO: 4406 - DNA, 9 bp, Artificial Sequence
  Synthetic nucleic acid molecule
tagtgaggg

SEQ ID NO: 4407 - DNA, 9 bp, Artificial Sequence
  Synthetic nucleic acid molecule
tagtgaggg

SEQ ID NO: 4408 - DNA, 9 bp, Artificial Sequence
  Synthetic nucleic acid molecule
gagtgagag

SEQ ID NO: 4409 - DNA, 9 bp, Artificial Sequence
  Synthetic nucleic acid molecule
tagtgaggg

SEQ ID NO: 4410 - DNA, 9 bp, Artificial Sequence
  Synthetic nucleic acid molecule
gagtgagat

SEQ ID NO: 4411 - DNA, 9 bp, Artificial Sequence
  Synthetic nucleic acid molecule
gagtgagag

SEQ ID NO: 4412 - DNA, 9 bp, Artificial Sequence
  Synthetic nucleic acid molecule
gagtgaaaa

SEQ ID NO: 4413 - DNA, 9 bp, Artificial Sequence
  Synthetic nucleic acid molecule
tagtgaggg

SEQ ID NO: 4414 - DNA, 9 bp, Artificial Sequence
  Synthetic nucleic acid molecule
gagtgagag

SEQ ID NO: 4415 - DNA, 9 bp, Artificial Sequence
  Synthetic nucleic acid molecule
gagtgagtc

SEQ ID NO: 4416 - DNA, 9 bp, Artificial Sequence
  Synthetic nucleic acid molecule
tagtgagaa

SEQ ID NO: 4417 - DNA, 9 bp, Artificial Sequence
  Synthetic nucleic acid molecule
cagtgaggg

SEQ ID NO: 4418 - DNA, 9 bp, Artificial Sequence
  Synthetic nucleic acid molecule
gagtgagag

SEQ ID NO: 4419 - DNA, 9 bp, Artificial Sequence
  Synthetic nucleic acid molecule
gagtgagtc

SEQ ID NO: 4420 - DNA, 9 bp, Artificial Sequence
  Synthetic nucleic acid molecule
tagtgaggg

SEQ ID NO: 4421 - DNA, 9 bp, Artificial Sequence
  Synthetic nucleic acid molecule
tagtgaggg

SEQ ID NO: 4422 - DNA, 9 bp, Artificial Sequence
  Synthetic nucleic acid molecule
gagtgtggg

SEQ ID NO: 4423 - DNA, 9 bp, Artificial Sequence
  Synthetic nucleic acid molecule
gagtgaggg

SEQ ID NO: 4424 - DNA, 9 bp, Artificial Sequence
  Synthetic nucleic acid molecule
gagtgaggc

SEQ ID NO: 4425 - DNA, 9 bp, Artificial Sequence
  Synthetic nucleic acid molecule
gagtgaggg

SEQ ID NO: 4426 - DNA, 9 bp, Artificial Sequence
  Synthetic nucleic acid molecule
gagtgaggt

SEQ ID NO: 4427 - DNA, 9 bp, Artificial Sequence
  Synthetic nucleic acid molecule
gagtgaggt

SEQ ID NO: 4428 - DNA, 9 bp, Artificial Sequence
  Synthetic nucleic acid molecule
gagtgaggc

SEQ ID NO: 4429 - DNA, 9 bp, Artificial Sequence
  Synthetic nucleic acid molecule
gagtgaggc

SEQ ID NO: 4430 - DNA, 9 bp, Artificial Sequence
  Synthetic nucleic acid molecule
gagtgaggg

SEQ ID NO: 4431 - DNA, 9 bp, Artificial Sequence
  Synthetic nucleic acid molecule
gagtgaggg

SEQ ID NO: 4432 - DNA, 9 bp, Artificial Sequence
  Synthetic nucleic acid molecule
gagtgaggc

SEQ ID NO: 4433 - DNA, 9 bp, Artificial Sequence
  Synthetic nucleic acid molecule
gagtgaggg

SEQ ID NO: 4434 - DNA, 9 bp, Artificial Sequence
  Synthetic nucleic acid molecule
gagtgaggc

SEQ ID NO: 4435 - DNA, 9 bp, Artificial Sequence
  Synthetic nucleic acid molecule
gagtgaggg

SEQ ID NO: 4436 - DNA, 9 bp, Artificial Sequence
  Synthetic nucleic acid molecule
gagtgaggg

SEQ ID NO: 4437 - DNA, 9 bp, Artificial Sequence
  Synthetic nucleic acid molecule
gagtgaggg

SEQ ID NO: 4438 - DNA, 9 bp, Artificial Sequence
  Synthetic nucleic acid molecule
gagtgaggt

SEQ ID NO: 4439 - DNA, 9 bp, Artificial Sequence
  Synthetic nucleic acid molecule
gagtgaggt

SEQ ID NO: 4440 - DNA, 9 bp, Artificial Sequence
  Synthetic nucleic acid molecule
gagtgaggc

SEQ ID NO: 4441 - DNA, 9 bp, Artificial Sequence
  Synthetic nucleic acid molecule
gagtgaggt

SEQ ID NO: 4442 - DNA, 9 bp, Artificial Sequence
  Synthetic nucleic acid molecule
gagtgaggg

SEQ ID NO: 4443 - DNA, 9 bp, Artificial Sequence
  Synthetic nucleic acid molecule
gagtgaggt

SEQ ID NO: 4444 - DNA, 9 bp, Artificial Sequence
  Synthetic nucleic acid molecule
gagtgaggg

SEQ ID NO: 4445 - DNA, 9 bp, Artificial Sequence
  Synthetic nucleic acid molecule
gagtgaggc

SEQ ID NO: 4446 - DNA, 9 bp, Artificial Sequence
  Synthetic nucleic acid molecule
gagtgaggc

SEQ ID NO: 4447 - DNA, 9 bp, Artificial Sequence
  Synthetic nucleic acid molecule
gagtgaggt

SEQ ID NO: 4448 - DNA, 9 bp, Artificial Sequence
  Synthetic nucleic acid molecule
gagtgaggt

SEQ ID NO: 4449 - DNA, 9 bp, Artificial Sequence
  Synthetic nucleic acid molecule
gagtgaggt

SEQ ID NO: 4450 - DNA, 9 bp, Artificial Sequence
  Synthetic nucleic acid molecule
gagtgaggg

SEQ ID NO: 4451 - DNA, 9 bp, Artificial Sequence
  Synthetic nucleic acid molecule
gagtgaggc

SEQ ID NO: 4452 - DNA, 9 bp, Artificial Sequence
  Synthetic nucleic acid molecule
gagtgaggt

SEQ ID NO: 4453 - DNA, 9 bp, Artificial Sequence
  Synthetic nucleic acid molecule
gagtgaggg

SEQ ID NO: 4454 - DNA, 9 bp, Artificial Sequence
  Synthetic nucleic acid molecule
gagtgaggt

SEQ ID NO: 4455 - DNA, 9 bp, Artificial Sequence
  Synthetic nucleic acid molecule
gagtgaggt

SEQ ID NO: 4456 - DNA, 9 bp, Artificial Sequence
  Synthetic nucleic acid molecule
gagtgaggt

SEQ ID NO: 4457 - DNA, 9 bp, Artificial Sequence
  Synthetic nucleic acid molecule
gagtgaggt

SEQ ID NO: 4458 - DNA, 9 bp, Artificial Sequence
  Synthetic nucleic acid molecule
gagtgagaa

SEQ ID NO: 4459 - DNA, 9 bp, Artificial Sequence
  Synthetic nucleic acid molecule
gagtgaggt

SEQ ID NO: 4460 - DNA, 9 bp, Artificial Sequence
  Synthetic nucleic acid molecule
gagtgaggt

SEQ ID NO: 4461 - DNA, 9 bp, Artificial Sequence
  Synthetic nucleic acid molecule
gagtgaggg

SEQ ID NO: 4462 - DNA, 9 bp, Artificial Sequence
  Synthetic nucleic acid molecule
gagtgaggc

SEQ ID NO: 4463 - DNA, 9 bp, Artificial Sequence
  Synthetic nucleic acid molecule
gagtgaggg

SEQ ID NO: 4464 - DNA, 9 bp, Artificial Sequence
  Synthetic nucleic acid molecule
gagtgaggg

SEQ ID NO: 4465 - DNA, 9 bp, Artificial Sequence
  Synthetic nucleic acid molecule
gagtgaggg

SEQ ID NO: 4466 - DNA, 9 bp, Artificial Sequence
  Synthetic nucleic acid molecule
gagtgaggg

SEQ ID NO: 4467 - DNA, 9 bp, Artificial Sequence
  Synthetic nucleic acid molecule
gagtgaggg

SEQ ID NO: 4468 - DNA, 9 bp, Artificial Sequence
  Synthetic nucleic acid molecule
gagtgaggg

SEQ ID NO: 4469 - DNA, 9 bp, Artificial Sequence
  Synthetic nucleic acid molecule
gagtgaggc

SEQ ID NO: 4470 - DNA, 9 bp, Artificial Sequence
  Synthetic nucleic acid molecule
gagtgaggt

SEQ ID NO: 4471 - DNA, 9 bp, Artificial Sequence
  Synthetic nucleic acid molecule
gagtgaggt

SEQ ID NO: 4472 - DNA, 9 bp, Artificial Sequence
  Synthetic nucleic acid molecule
gagtgaggg

SEQ ID NO: 4473 - DNA, 9 bp, Artificial Sequence
  Synthetic nucleic acid molecule
gagtgaggc

SEQ ID NO: 4474 - DNA, 9 bp, Artificial Sequence
  Synthetic nucleic acid molecule
gagtgaggg

SEQ ID NO: 4475 - DNA, 9 bp, Artificial Sequence
  Synthetic nucleic acid molecule
gagtgaggg

SEQ ID NO: 4476 - DNA, 9 bp, Artificial Sequence
  Synthetic nucleic acid molecule
gagtgaggt

SEQ ID NO: 4477 - DNA, 9 bp, Artificial Sequence
  Synthetic nucleic acid molecule
gagtgaggt

SEQ ID NO: 4478 - DNA, 9 bp, Artificial Sequence
  Synthetic nucleic acid molecule
gagtgaggt

SEQ ID NO: 4479 - DNA, 9 bp, Artificial Sequence
  Synthetic nucleic acid molecule
gagtgaggc

SEQ ID NO: 4480 - DNA, 9 bp, Artificial Sequence
  Synthetic nucleic acid molecule
gagtgaggc

SEQ ID NO: 4481 - DNA, 9 bp, Artificial Sequence
  Synthetic nucleic acid molecule
gagtgaggt

SEQ ID NO: 4482 - DNA, 9 bp, Artificial Sequence
  Synthetic nucleic acid molecule
gagtgaggg

SEQ ID NO: 4483 - DNA, 9 bp, Artificial Sequence
  Synthetic nucleic acid molecule
gagtgaggc

SEQ ID NO: 4484 - DNA, 9 bp, Artificial Sequence
  Synthetic nucleic acid molecule
gagtgaggg

SEQ ID NO: 4485 - DNA, 9 bp, Artificial Sequence
  Synthetic nucleic acid molecule
gagtgaggt

SEQ ID NO: 4486 - DNA, 9 bp, Artificial Sequence
  Synthetic nucleic acid molecule
gagggagga

SEQ ID NO: 4487 - DNA, 9 bp, Artificial Sequence
  Synthetic nucleic acid molecule
gagtgaggt

SEQ ID NO: 4488 - DNA, 9 bp, Artificial Sequence
  Synthetic nucleic acid molecule
gagtgaggg

SEQ ID NO: 4489 - DNA, 9 bp, Artificial Sequence
  Synthetic nucleic acid molecule
gagtgaggc

SEQ ID NO: 4490 - DNA, 9 bp, Artificial Sequence
  Synthetic nucleic acid molecule
gagtgaggt

SEQ ID NO: 4491 - DNA, 9 bp, Artificial Sequence
  Synthetic nucleic acid molecule
gagtgaggt

SEQ ID NO: 4492 - DNA, 9 bp, Artificial Sequence
  Synthetic nucleic acid molecule
gagtgaggg

SEQ ID NO: 4493 - DNA, 9 bp, Artificial Sequence
  Synthetic nucleic acid molecule
gagtgaggg

SEQ ID NO: 4494 - DNA, 9 bp, Artificial Sequence
  Synthetic nucleic acid molecule
gagtgaggg

SEQ ID NO: 4495 - DNA, 9 bp, Artificial Sequence
  Synthetic nucleic acid molecule
gagtgaggt

SEQ ID NO: 4496 - DNA, 9 bp, Artificial Sequence
  Synthetic nucleic acid molecule
gagtgaggg

SEQ ID NO: 4497 - DNA, 9 bp, Artificial Sequence
  Synthetic nucleic acid molecule
gagtgaggc

SEQ ID NO: 4498 - DNA, 9 bp, Artificial Sequence
  Synthetic nucleic acid molecule
aagtgagga

SEQ ID NO: 4499 - DNA, 9 bp, Artificial Sequence
  Synthetic nucleic acid molecule
gagtgaggg

SEQ ID NO: 4500 - DNA, 9 bp, Artificial Sequence
  Synthetic nucleic acid molecule
gagtgaggg

SEQ ID NO: 4501 - DNA, 9 bp, Artificial Sequence
  Synthetic nucleic acid molecule
gagtgaggg

SEQ ID NO: 4502 - DNA, 9 bp, Artificial Sequence
  Synthetic nucleic acid molecule
gagtgaggg

SEQ ID NO: 4503 - DNA, 9 bp, Artificial Sequence
  Synthetic nucleic acid molecule
gagtgaggg

SEQ ID NO: 4504 - DNA, 9 bp, Artificial Sequence
  Synthetic nucleic acid molecule
gagtgaggg

SEQ ID NO: 4505 - DNA, 9 bp, Artificial Sequence
  Synthetic nucleic acid molecule
gagtgaggc

SEQ ID NO: 4506 - DNA, 9 bp, Artificial Sequence
  Synthetic nucleic acid molecule
gagtgaggc

SEQ ID NO: 4507 - DNA, 9 bp, Artificial Sequence
  Synthetic nucleic acid molecule
gagtgaggg

SEQ ID NO: 4508 - DNA, 9 bp, Artificial Sequence
  Synthetic nucleic acid molecule
gagtgaggc

SEQ ID NO: 4509 - DNA, 9 bp, Artificial Sequence
  Synthetic nucleic acid molecule
gagtgaggt

SEQ ID NO: 4510 - DNA, 9 bp, Artificial Sequence
  Synthetic nucleic acid molecule
gagtgaggg

SEQ ID NO: 4511 - DNA, 9 bp, Artificial Sequence
  Synthetic nucleic acid molecule
gagtgagca

SEQ ID NO: 4512 - DNA, 9 bp, Artificial Sequence
  Synthetic nucleic acid molecule
gagtgaggt

SEQ ID NO: 4513 - DNA, 9 bp, Artificial Sequence
  Synthetic nucleic acid molecule
gagtgaggg

SEQ ID NO: 4514 - DNA, 9 bp, Artificial Sequence
  Synthetic nucleic acid molecule
gagtgaggg

SEQ ID NO: 4515 - DNA, 9 bp, Artificial Sequence
  Synthetic nucleic acid molecule
gagtgaggc

SEQ ID NO: 4516 - DNA, 9 bp, Artificial Sequence
  Synthetic nucleic acid molecule
gagtgaggg

SEQ ID NO: 4517 - DNA, 9 bp, Artificial Sequence
  Synthetic nucleic acid molecule
gagtgaggt

SEQ ID NO: 4518 - DNA, 9 bp, Artificial Sequence
  Synthetic nucleic acid molecule
gagtgaggc

SEQ ID NO: 4519 - DNA, 9 bp, Artificial Sequence
  Synthetic nucleic acid molecule
gagtgaggc

SEQ ID NO: 4520 - DNA, 9 bp, Artificial Sequence
  Synthetic nucleic acid molecule
gagtgaggg

SEQ ID NO: 4521 - DNA, 9 bp, Artificial Sequence
  Synthetic nucleic acid molecule
gagtgaggc

SEQ ID NO: 4522 - DNA, 9 bp, Artificial Sequence
  Synthetic nucleic acid molecule
gagtgagga

SEQ ID NO: 4523 - DNA, 9 bp, Artificial Sequence
  Synthetic nucleic acid molecule
gagtgagga

SEQ ID NO: 4524 - DNA, 9 bp, Artificial Sequence
  Synthetic nucleic acid molecule
gagtgagga

SEQ ID NO: 4525 - DNA, 9 bp, Artificial Sequence
  Synthetic nucleic acid molecule
gagtgagga

SEQ ID NO: 4526 - DNA, 9 bp, Artificial Sequence
  Synthetic nucleic acid molecule
gagtgagga

SEQ ID NO: 4527 - DNA, 9 bp, Artificial Sequence
  Synthetic nucleic acid molecule
gagtgagga

SEQ ID NO: 4528 - DNA, 9 bp, Artificial Sequence
  Synthetic nucleic acid molecule
gagtgagga

SEQ ID NO: 4529 - DNA, 9 bp, Artificial Sequence
  Synthetic nucleic acid molecule
gagtgaagt

SEQ ID NO: 4530 - DNA, 9 bp, Artificial Sequence
  Synthetic nucleic acid molecule
gagagaggc

SEQ ID NO: 4531 - DNA, 9 bp, Artificial Sequence
  Synthetic nucleic acid molecule
gagtgaagt

SEQ ID NO: 4532 - DNA, 9 bp, Artificial Sequence
  Synthetic nucleic acid molecule
gagtgagtt

SEQ ID NO: 4533 - DNA, 9 bp, Artificial Sequence
  Synthetic nucleic acid molecule
gagtgaggg

SEQ ID NO: 4534 - DNA, 9 bp, Artificial Sequence
  Synthetic nucleic acid molecule
gagtgaggg

SEQ ID NO: 4535 - DNA, 9 bp, Artificial Sequence
  Synthetic nucleic acid molecule
atgtgagga

SEQ ID NO: 4536 - DNA, 9 bp, Artificial Sequence
  Synthetic nucleic acid molecule
gagtgagga

SEQ ID NO: 4537 - DNA, 9 bp, Artificial Sequence
  Synthetic nucleic acid molecule
gagtgagtc

SEQ ID NO: 4538 - DNA, 9 bp, Artificial Sequence
  Synthetic nucleic acid molecule
gagagagga

SEQ ID NO: 4539 - DNA, 9 bp, Artificial Sequence
  Synthetic nucleic acid molecule
gagagagga

SEQ ID NO: 4540 - DNA, 9 bp, Artificial Sequence
  Synthetic nucleic acid molecule
gagagagga

SEQ ID NO: 4541 - DNA, 9 bp, Artificial Sequence
  Synthetic nucleic acid molecule
gagagagga

SEQ ID NO: 4542 - DNA, 9 bp, Artificial Sequence
  Synthetic nucleic acid molecule
gggtgagga

SEQ ID NO: 4543 - DNA, 9 bp, Artificial Sequence
  Synthetic nucleic acid molecule
gagggagga

SEQ ID NO: 4544 - DNA, 9 bp, Artificial Sequence
  Synthetic nucleic acid molecule
gagtgatga

SEQ ID NO: 4545 - DNA, 9 bp, Artificial Sequence
  Synthetic nucleic acid molecule
gagtgacga

SEQ ID NO: 4546 - DNA, 9 bp, Artificial Sequence
  Synthetic nucleic acid molecule
gcgtgagga

SEQ ID NO: 4547 - DNA, 9 bp, Artificial Sequence
  Synthetic nucleic acid molecule
gagtcagga

SEQ ID NO: 4548 - DNA, 9 bp, Artificial Sequence
  Synthetic nucleic acid molecule
gaatgagga

SEQ ID NO: 4549 - DNA, 9 bp, Artificial Sequence
  Synthetic nucleic acid molecule
gactgagga

SEQ ID NO: 4550 - DNA, 9 bp, Artificial Sequence
  Synthetic nucleic acid molecule
gagagagga

SEQ ID NO: 4551 - DNA, 9 bp, Artificial Sequence
  Synthetic nucleic acid molecule
gagagagga

SEQ ID NO: 4552 - DNA, 9 bp, Artificial Sequence
  Synthetic nucleic acid molecule
gcgtgagga

SEQ ID NO: 4553 - DNA, 9 bp, Artificial Sequence
  Synthetic nucleic acid molecule
gggtgagga

SEQ ID NO: 4554 - DNA, 9 bp, Artificial Sequence
  Synthetic nucleic acid molecule
gaatgagga

SEQ ID NO: 4555 - DNA, 9 bp, Artificial Sequence
  Synthetic nucleic acid molecule
gagtgagga

SEQ ID NO: 4556 - DNA, 9 bp, Artificial Sequence
  Synthetic nucleic acid molecule
gagtgagga

SEQ ID NO: 4557 - DNA, 9 bp, Artificial Sequence
  Synthetic nucleic acid molecule
gagtgagga

SEQ ID NO: 4558 - DNA, 9 bp, Artificial Sequence
  Synthetic nucleic acid molecule
gagtgagga

SEQ ID NO: 4559 - DNA, 9 bp, Artificial Sequence
  Synthetic nucleic acid molecule
gagtgagga

SEQ ID NO: 4560 - DNA, 9 bp, Artificial Sequence
  Synthetic nucleic acid molecule
gagtgagga

SEQ ID NO: 4561 - DNA, 9 bp, Artificial Sequence
  Synthetic nucleic acid molecule
gagtgagga

SEQ ID NO: 4562 - DNA, 9 bp, Artificial Sequence
  Synthetic nucleic acid molecule
gagtgagga

SEQ ID NO: 4563 - DNA, 9 bp, Artificial Sequence
  Synthetic nucleic acid molecule
gagtgagga

SEQ ID NO: 4564 - DNA, 9 bp, Artificial Sequence
  Synthetic nucleic acid molecule
gagtgagga

SEQ ID NO: 4565 - DNA, 9 bp, Artificial Sequence
  Synthetic nucleic acid molecule
gagtgagga

SEQ ID NO: 4566 - DNA, 9 bp, Artificial Sequence
  Synthetic nucleic acid molecule
gagtgagga

SEQ ID NO: 4567 - DNA, 9 bp, Artificial Sequence
  Synthetic nucleic acid molecule
gagtgagga

SEQ ID NO: 4568 - DNA, 9 bp, Artificial Sequence
  Synthetic nucleic acid molecule
gagtgagga

SEQ ID NO: 4569 - DNA, 9 bp, Artificial Sequence
  Synthetic nucleic acid molecule
gagtgagga

SEQ ID NO: 4570 - DNA, 9 bp, Artificial Sequence
  Synthetic nucleic acid molecule
gagtgagga

SEQ ID NO: 4571 - DNA, 9 bp, Artificial Sequence
  Synthetic nucleic acid molecule
gagtgagga

SEQ ID NO: 4572 - DNA, 9 bp, Artificial Sequence
  Synthetic nucleic acid molecule
gagtgagga

SEQ ID NO: 4573 - DNA, 9 bp, Artificial Sequence
  Synthetic nucleic acid molecule
gagtgagga

SEQ ID NO: 4574 - DNA, 9 bp, Artificial Sequence
  Synthetic nucleic acid molecule
gagtgagga

SEQ ID NO: 4575 - DNA, 9 bp, Artificial Sequence
  Synthetic nucleic acid molecule
gagtgagga

SEQ ID NO: 4576 - DNA, 9 bp, Artificial Sequence
  Synthetic nucleic acid molecule
gagtgagga

SEQ ID NO: 4577 - DNA, 9 bp, Artificial Sequence
  Synthetic nucleic acid molecule
gagtgagga

SEQ ID NO: 4578 - DNA, 9 bp, Artificial Sequence
  Synthetic nucleic acid molecule
gagtgagga

SEQ ID NO: 4579 - DNA, 9 bp, Artificial Sequence
  Synthetic nucleic acid molecule
gagtgagga

SEQ ID NO: 4580 - DNA, 9 bp, Artificial Sequence
  Synthetic nucleic acid molecule
gagtgagga

SEQ ID NO: 4581 - DNA, 9 bp, Artificial Sequence
  Synthetic nucleic acid molecule
gagtgagga

SEQ ID NO: 4582 - DNA, 9 bp, Artificial Sequence
  Synthetic nucleic acid molecule
gagtgagga

SEQ ID NO: 4583 - DNA, 9 bp, Artificial Sequence
  Synthetic nucleic acid molecule
gagtgagga

SEQ ID NO: 4584 - DNA, 9 bp, Artificial Sequence
  Synthetic nucleic acid molecule
gagtgagga

SEQ ID NO: 4585 - DNA, 9 bp, Artificial Sequence
  Synthetic nucleic acid molecule
gagtgagga

SEQ ID NO: 4586 - DNA, 9 bp, Artificial Sequence
  Synthetic nucleic acid molecule
gagtgagga

SEQ ID NO: 4587 - DNA, 9 bp, Artificial Sequence
  Synthetic nucleic acid molecule
gagtgagga

SEQ ID NO: 4588 - DNA, 9 bp, Artificial Sequence
  Synthetic nucleic acid molecule
gagtgagga

SEQ ID NO: 4589 - DNA, 9 bp, Artificial Sequence
  Synthetic nucleic acid molecule
gagtgagga

SEQ ID NO: 4590 - DNA, 9 bp, Artificial Sequence
  Synthetic nucleic acid molecule
gagtgagga

SEQ ID NO: 4591 - DNA, 9 bp, Artificial Sequence
  Synthetic nucleic acid molecule
gagtgagga

SEQ ID NO: 4592 - DNA, 9 bp, Artificial Sequence
  Synthetic nucleic acid molecule
aaattagga

SEQ ID NO: 4593 - DNA, 9 bp, Artificial Sequence
  Synthetic nucleic acid molecule
gaccgaggt

SEQ ID NO: 4594 - DNA, 9 bp, Artificial Sequence
  Synthetic nucleic acid molecule
gcgtggcga

SEQ ID NO: 4595 - DNA, 9 bp, Artificial Sequence
  Synthetic nucleic acid molecule
ggtggagga

SEQ ID NO: 4596 - DNA, 9 bp, Artificial Sequence
  Synthetic nucleic acid molecule
gagtcagcc

SEQ ID NO: 4597 - DNA, 9 bp, Artificial Sequence
  Synthetic nucleic acid molecule
aagtcaggt

SEQ ID NO: 4598 - DNA, 9 bp, Artificial Sequence
  Synthetic nucleic acid molecule
gcctgatga

SEQ ID NO: 4599 - DNA, 9 bp, Artificial Sequence
  Synthetic nucleic acid molecule
gacagagaa

SEQ ID NO: 4600 - DNA, 9 bp, Artificial Sequence
  Synthetic nucleic acid molecule
gtttgggga

SEQ ID NO: 4601 - DNA, 9 bp, Artificial Sequence
  Synthetic nucleic acid molecule
gagacagca

SEQ ID NO: 4602 - DNA, 9 bp, Artificial Sequence
  Synthetic nucleic acid molecule
gagctggga

SEQ ID NO: 4603 - DNA, 9 bp, Artificial Sequence
  Synthetic nucleic acid molecule
gcggcagga

SEQ ID NO: 4604 - DNA, 9 bp, Artificial Sequence
  Synthetic nucleic acid molecule
gcggcagga

SEQ ID NO: 4605 - DNA, 9 bp, Artificial Sequence
  Synthetic nucleic acid molecule
aagcgagta

SEQ ID NO: 4606 - DNA, 9 bp, Artificial Sequence
  Synthetic nucleic acid molecule
cagagagca

SEQ ID NO: 4607 - DNA, 9 bp, Artificial Sequence
  Synthetic nucleic acid molecule
ggctgggga

SEQ ID NO: 4608 - DNA, 9 bp, Artificial Sequence
  Synthetic nucleic acid molecule
ggctgggga

SEQ ID NO: 4609 - DNA, 9 bp, Artificial Sequence
  Synthetic nucleic acid molecule
gagtcatgt

SEQ ID NO: 4610 - DNA, 9 bp, Artificial Sequence
  Synthetic nucleic acid molecule
gcgggggga

SEQ ID NO: 4611 - DNA, 9 bp, Artificial Sequence
  Synthetic nucleic acid molecule
aattgggga

SEQ ID NO: 4612 - DNA, 9 bp, Artificial Sequence
  Synthetic nucleic acid molecule
gagtcagcc

SEQ ID NO: 4613 - DNA, 9 bp, Artificial Sequence
  Synthetic nucleic acid molecule
gcgggagga

SEQ ID NO: 4614 - DNA, 9 bp, Artificial Sequence
  Synthetic nucleic acid molecule
gggtgaggc

SEQ ID NO: 4615 - DNA, 9 bp, Artificial Sequence
  Synthetic nucleic acid molecule
gagtgaaca

SEQ ID NO: 4616 - DNA, 9 bp, Artificial Sequence
  Synthetic nucleic acid molecule
gagtgaagc

SEQ ID NO: 4617 - DNA, 9 bp, Artificial Sequence
  Synthetic nucleic acid molecule
gagtgtgca

SEQ ID NO: 4618 - DNA, 9 bp, Artificial Sequence
  Synthetic nucleic acid molecule
tagtgagca

SEQ ID NO: 4619 - DNA, 9 bp, Artificial Sequence
  Synthetic nucleic acid molecule
tagtaagga

SEQ ID NO: 4620 - DNA, 9 bp, Artificial Sequence
  Synthetic nucleic acid molecule
aagtgagaa

SEQ ID NO: 4621 - DNA, 9 bp, Artificial Sequence
  Synthetic nucleic acid molecule
gagtgtggg

SEQ ID NO: 4622 - DNA, 9 bp, Artificial Sequence
  Synthetic nucleic acid molecule
cagtgagaa

SEQ ID NO: 4623 - DNA, 9 bp, Artificial Sequence
  Synthetic nucleic acid molecule
gggtgaggc

SEQ ID NO: 4624 - DNA, 9 bp, Artificial Sequence
  Synthetic nucleic acid molecule
gggtgaggc

SEQ ID NO: 4625 - DNA, 9 bp, Artificial Sequence
  Synthetic nucleic acid molecule
gagtgtggt

SEQ ID NO: 4626 - DNA, 9 bp, Artificial Sequence
  Synthetic nucleic acid molecule
gagggaggg

SEQ ID NO: 4627 - DNA, 9 bp, Artificial Sequence
  Synthetic nucleic acid molecule
gtgtgagaa

SEQ ID NO: 4628 - DNA, 9 bp, Artificial Sequence
  Synthetic nucleic acid molecule
aggtgagga

SEQ ID NO: 4629 - DNA, 9 bp, Artificial Sequence
  Synthetic nucleic acid molecule
cagtgatga

SEQ ID NO: 4630 - DNA, 9 bp, Artificial Sequence
  Synthetic nucleic acid molecule
gagggaggg

SEQ ID NO: 4631 - DNA, 9 bp, Artificial Sequence
  Synthetic nucleic acid molecule
tggtgagga

SEQ ID NO: 4632 - DNA, 9 bp, Artificial Sequence
  Synthetic nucleic acid molecule
aagtgaaga

SEQ ID NO: 4633 - DNA, 9 bp, Artificial Sequence
  Synthetic nucleic acid molecule
gagtgaagg

SEQ ID NO: 4634 - DNA, 9 bp, Artificial Sequence
  Synthetic nucleic acid molecule
gggtaagga

SEQ ID NO: 4635 - DNA, 9 bp, Artificial Sequence
  Synthetic nucleic acid molecule
gagtggggc

SEQ ID NO: 4636 - DNA, 9 bp, Artificial Sequence
  Synthetic nucleic acid molecule
gagtgataa

SEQ ID NO: 4637 - DNA, 9 bp, Artificial Sequence
  Synthetic nucleic acid molecule
gggtaagga

SEQ ID NO: 4638 - DNA, 9 bp, Artificial Sequence
  Synthetic nucleic acid molecule
gggtaagga

SEQ ID NO: 4639 - DNA, 9 bp, Artificial Sequence
  Synthetic nucleic acid molecule
gggtaagga

SEQ ID NO: 4640 - DNA, 9 bp, Artificial Sequence
  Synthetic nucleic acid molecule
gggtaagga

SEQ ID NO: 4641 - DNA, 9 bp, Artificial Sequence
  Synthetic nucleic acid molecule
gaatgaggc

SEQ ID NO: 4642 - DNA, 9 bp, Artificial Sequence
  Synthetic nucleic acid molecule
gagggagaa

SEQ ID NO: 4643 - DNA, 9 bp, Artificial Sequence
  Synthetic nucleic acid molecule
gagtgtgaa

SEQ ID NO: 4644 - DNA, 9 bp, Artificial Sequence
  Synthetic nucleic acid molecule
gattgaaga

SEQ ID NO: 4645 - DNA, 9 bp, Artificial Sequence
  Synthetic nucleic acid molecule
gagggagaa

SEQ ID NO: 4646 - DNA, 9 bp, Artificial Sequence
  Synthetic nucleic acid molecule
gagagaggc

SEQ ID NO: 4647 - DNA, 9 bp, Artificial Sequence
  Synthetic nucleic acid molecule
gaaggagga

SEQ ID NO: 4648 - DNA, 9 bp, Artificial Sequence
  Synthetic nucleic acid molecule
gagagaggg

SEQ ID NO: 4649 - DNA, 9 bp, Artificial Sequence
  Synthetic nucleic acid molecule
gagtgggta

SEQ ID NO: 4650 - DNA, 9 bp, Artificial Sequence
  Synthetic nucleic acid molecule
aaatgagga

SEQ ID NO: 4651 - DNA, 9 bp, Artificial Sequence
  Synthetic nucleic acid molecule
tggtgagga

SEQ ID NO: 4652 - DNA, 9 bp, Artificial Sequence
  Synthetic nucleic acid molecule
gaggaagga

SEQ ID NO: 4653 - DNA, 9 bp, Artificial Sequence
  Synthetic nucleic acid molecule
gactgaaga

SEQ ID NO: 4654 - DNA, 9 bp, Artificial Sequence
  Synthetic nucleic acid molecule
ttgtgagga

SEQ ID NO: 4655 - DNA, 9 bp, Artificial Sequence
  Synthetic nucleic acid molecule
cagtgatga

SEQ ID NO: 4656 - DNA, 9 bp, Artificial Sequence
  Synthetic nucleic acid molecule
aagggagga

SEQ ID NO: 4657 - DNA, 9 bp, Artificial Sequence
  Synthetic nucleic acid molecule
gagtcagta

SEQ ID NO: 4658 - DNA, 9 bp, Artificial Sequence
  Synthetic nucleic acid molecule
gagtaaggg

SEQ ID NO: 4659 - DNA, 9 bp, Artificial Sequence
  Synthetic nucleic acid molecule
gtgtgagaa

SEQ ID NO: 4660 - DNA, 9 bp, Artificial Sequence
  Synthetic nucleic acid molecule
gagtgcggc

SEQ ID NO: 4661 - DNA, 9 bp, Artificial Sequence
  Synthetic nucleic acid molecule
cagtgagaa

SEQ ID NO: 4662 - DNA, 9 bp, Artificial Sequence
  Synthetic nucleic acid molecule
gagtgaaca

SEQ ID NO: 4663 - DNA, 9 bp, Artificial Sequence
  Synthetic nucleic acid molecule
aactgagga

SEQ ID NO: 4664 - DNA, 9 bp, Artificial Sequence
  Synthetic nucleic acid molecule
gagggaggg

SEQ ID NO: 4665 - DNA, 9 bp, Artificial Sequence
  Synthetic nucleic acid molecule
gagtgggaa

SEQ ID NO: 4666 - DNA, 9 bp, Artificial Sequence
  Synthetic nucleic acid molecule
aagtgaggg

SEQ ID NO: 4667 - DNA, 9 bp, Artificial Sequence
  Synthetic nucleic acid molecule
gagtgagct

SEQ ID NO: 4668 - DNA, 9 bp, Artificial Sequence
  Synthetic nucleic acid molecule
gagtggggc

SEQ ID NO: 4669 - DNA, 9 bp, Artificial Sequence
  Synthetic nucleic acid molecule
gagacagga

SEQ ID NO: 4670 - DNA, 9 bp, Artificial Sequence
  Synthetic nucleic acid molecule
gaatgggga

SEQ ID NO: 4671 - DNA, 9 bp, Artificial Sequence
  Synthetic nucleic acid molecule
gggtgaggc

SEQ ID NO: 4672 - DNA, 9 bp, Artificial Sequence
  Synthetic nucleic acid molecule
gagggaggt

SEQ ID NO: 4673 - DNA, 9 bp, Artificial Sequence
  Synthetic nucleic acid molecule
gggcgagga

SEQ ID NO: 4674 - DNA, 9 bp, Artificial Sequence
  Synthetic nucleic acid molecule
gagggaaga

SEQ ID NO: 4675 - DNA, 9 bp, Artificial Sequence
  Synthetic nucleic acid molecule
gagggagca

SEQ ID NO: 4676 - DNA, 9 bp, Artificial Sequence
  Synthetic nucleic acid molecule
gaggcagga

SEQ ID NO: 4677 - DNA, 9 bp, Artificial Sequence
  Synthetic nucleic acid molecule
gagggagaa

SEQ ID NO: 4678 - DNA, 9 bp, Artificial Sequence
  Synthetic nucleic acid molecule
tggtgagga

SEQ ID NO: 4679 - DNA, 9 bp, Artificial Sequence
  Synthetic nucleic acid molecule
aagagagga

SEQ ID NO: 4680 - DNA, 9 bp, Artificial Sequence
  Synthetic nucleic acid molecule
gagtggaga

SEQ ID NO: 4681 - DNA, 9 bp, Artificial Sequence
  Synthetic nucleic acid molecule
gagggaggt

SEQ ID NO: 4682 - DNA, 9 bp, Artificial Sequence
  Synthetic nucleic acid molecule
aagtgaggg

SEQ ID NO: 4683 - DNA, 9 bp, Artificial Sequence
  Synthetic nucleic acid molecule
gagtaagca

SEQ ID NO: 4684 - DNA, 9 bp, Artificial Sequence
  Synthetic nucleic acid molecule
tagtgatga

SEQ ID NO: 4685 - DNA, 9 bp, Artificial Sequence
  Synthetic nucleic acid molecule
gagaaagga

SEQ ID NO: 4686 - DNA, 9 bp, Artificial Sequence
  Synthetic nucleic acid molecule
gagtgcaga

SEQ ID NO: 4687 - DNA, 9 bp, Artificial Sequence
  Synthetic nucleic acid molecule
gaggaagga

SEQ ID NO: 4688 - DNA, 9 bp, Artificial Sequence
  Synthetic nucleic acid molecule
gaatgagaa

SEQ ID NO: 4689 - DNA, 9 bp, Artificial Sequence
  Synthetic nucleic acid molecule
gagggaggt

SEQ ID NO: 4690 - DNA, 9 bp, Artificial Sequence
  Synthetic nucleic acid molecule
gtgtgaggg

SEQ ID NO: 4691 - DNA, 9 bp, Artificial Sequence
  Synthetic nucleic acid molecule
aagtgagaa

SEQ ID NO: 4692 - DNA, 9 bp, Artificial Sequence
  Synthetic nucleic acid molecule
gactgaggt

SEQ ID NO: 4693 - DNA, 9 bp, Artificial Sequence
  Synthetic nucleic acid molecule
gtgtcagga

SEQ ID NO: 4694 - DNA, 9 bp, Artificial Sequence
  Synthetic nucleic acid molecule
gagtgtgaa

SEQ ID NO: 4695 - DNA, 9 bp, Artificial Sequence
  Synthetic nucleic acid molecule
gagtgagtg

SEQ ID NO: 4696 - DNA, 9 bp, Artificial Sequence
  Synthetic nucleic acid molecule
gagttaaga

SEQ ID NO: 4697 - DNA, 9 bp, Artificial Sequence
  Synthetic nucleic acid molecule
gagcgagca

SEQ ID NO: 4698 - DNA, 9 bp, Artificial Sequence
  Synthetic nucleic acid molecule
gagacagga

SEQ ID NO: 4699 - DNA, 9 bp, Artificial Sequence
  Synthetic nucleic acid molecule
cagttagga

SEQ ID NO: 4700 - DNA, 9 bp, Artificial Sequence
  Synthetic nucleic acid molecule
gagtgaagc

SEQ ID NO: 4701 - DNA, 9 bp, Artificial Sequence
  Synthetic nucleic acid molecule
tggtgagga

SEQ ID NO: 4702 - DNA, 9 bp, Artificial Sequence
  Synthetic nucleic acid molecule
gaggcagga

SEQ ID NO: 4703 - DNA, 9 bp, Artificial Sequence
  Synthetic nucleic acid molecule
aggtgagga

SEQ ID NO: 4704 - DNA, 9 bp, Artificial Sequence
  Synthetic nucleic acid molecule
gagtcagca

SEQ ID NO: 4705 - DNA, 9 bp, Artificial Sequence
  Synthetic nucleic acid molecule
gagggagaa

SEQ ID NO: 4706 - DNA, 9 bp, Artificial Sequence
  Synthetic nucleic acid molecule
gtgagagga

SEQ ID NO: 4707 - DNA, 9 bp, Artificial Sequence
  Synthetic nucleic acid molecule
gagtgggta

SEQ ID NO: 4708 - DNA, 9 bp, Artificial Sequence
  Synthetic nucleic acid molecule
cagtgagaa

SEQ ID NO: 4709 - DNA, 9 bp, Artificial Sequence
  Synthetic nucleic acid molecule
gagtgggta

SEQ ID NO: 4710 - DNA, 9 bp, Artificial Sequence
  Synthetic nucleic acid molecule
gactgaggt

SEQ ID NO: 4711 - DNA, 9 bp, Artificial Sequence
  Synthetic nucleic acid molecule
gggggagga

SEQ ID NO: 4712 - DNA, 9 bp, Artificial Sequence
  Synthetic nucleic acid molecule
gagagaggg

SEQ ID NO: 4713 - DNA, 9 bp, Artificial Sequence
  Synthetic nucleic acid molecule
aagtgagca

SEQ ID NO: 4714 - DNA, 9 bp, Artificial Sequence
  Synthetic nucleic acid molecule
gagtgagac

SEQ ID NO: 4715 - DNA, 9 bp, Artificial Sequence
  Synthetic nucleic acid molecule
gagagtgga

SEQ ID NO: 4716 - DNA, 9 bp, Artificial Sequence
  Synthetic nucleic acid molecule
aagtgcgga

SEQ ID NO: 4717 - DNA, 9 bp, Artificial Sequence
  Synthetic nucleic acid molecule
aagtgagaa

SEQ ID NO: 4718 - DNA, 9 bp, Artificial Sequence
  Synthetic nucleic acid molecule
gagtgaagg

SEQ ID NO: 4719 - DNA, 9 bp, Artificial Sequence
  Synthetic nucleic acid molecule
cagcgagga

SEQ ID NO: 4720 - DNA, 9 bp, Artificial Sequence
  Synthetic nucleic acid molecule
tggtgagga

SEQ ID NO: 4721 - DNA, 9 bp, Artificial Sequence
  Synthetic nucleic acid molecule
gagtgtggt

SEQ ID NO: 4722 - DNA, 9 bp, Artificial Sequence
  Synthetic nucleic acid molecule
aggtgagga

SEQ ID NO: 4723 - DNA, 9 bp, Artificial Sequence
  Synthetic nucleic acid molecule
gaatgaggc

SEQ ID NO: 4724 - DNA, 9 bp, Artificial Sequence
  Synthetic nucleic acid molecule
gaatgagta

SEQ ID NO: 4725 - DNA, 9 bp, Artificial Sequence
  Synthetic nucleic acid molecule
gagggagaa

SEQ ID NO: 4726 - DNA, 9 bp, Artificial Sequence
  Synthetic nucleic acid molecule
gagtgcggc

SEQ ID NO: 4727 - DNA, 9 bp, Artificial Sequence
  Synthetic nucleic acid molecule
gagggaggg

SEQ ID NO: 4728 - DNA, 9 bp, Artificial Sequence
  Synthetic nucleic acid molecule
gagggaggg

SEQ ID NO: 4729 - DNA, 9 bp, Artificial Sequence
  Synthetic nucleic acid molecule
tagtgaaga

SEQ ID NO: 4730 - DNA, 9 bp, Artificial Sequence
  Synthetic nucleic acid molecule
gagagtgga

SEQ ID NO: 4731 - DNA, 9 bp, Artificial Sequence
  Synthetic nucleic acid molecule
gagggaggg

SEQ ID NO: 4732 - DNA, 9 bp, Artificial Sequence
  Synthetic nucleic acid molecule
gggtgaggt

SEQ ID NO: 4733 - DNA, 9 bp, Artificial Sequence
  Synthetic nucleic acid molecule
cagtgaggc

SEQ ID NO: 4734 - DNA, 9 bp, Artificial Sequence
  Synthetic nucleic acid molecule
gaatgaggg

SEQ ID NO: 4735 - DNA, 9 bp, Artificial Sequence
  Synthetic nucleic acid molecule
gagtggggg

SEQ ID NO: 4736 - DNA, 9 bp, Artificial Sequence
  Synthetic nucleic acid molecule
gagtggggc

SEQ ID NO: 4737 - DNA, 9 bp, Artificial Sequence
  Synthetic nucleic acid molecule
gagaaagga

SEQ ID NO: 4738 - DNA, 9 bp, Artificial Sequence
  Synthetic nucleic acid molecule
gagggaggg

SEQ ID NO: 4739 - DNA, 9 bp, Artificial Sequence
  Synthetic nucleic acid molecule
gagagagaa

SEQ ID NO: 4740 - DNA, 9 bp, Artificial Sequence
  Synthetic nucleic acid molecule
gagtgaaaa

SEQ ID NO: 4741 - DNA, 9 bp, Artificial Sequence
  Synthetic nucleic acid molecule
gagtaagaa

SEQ ID NO: 4742 - DNA, 9 bp, Artificial Sequence
  Synthetic nucleic acid molecule
aagtgagca

SEQ ID NO: 4743 - DNA, 9 bp, Artificial Sequence
  Synthetic nucleic acid molecule
tggtgagga

SEQ ID NO: 4744 - DNA, 9 bp, Artificial Sequence
  Synthetic nucleic acid molecule
ctgtgagga

SEQ ID NO: 4745 - DNA, 9 bp, Artificial Sequence
  Synthetic nucleic acid molecule
gagtggggc

SEQ ID NO: 4746 - DNA, 9 bp, Artificial Sequence
  Synthetic nucleic acid molecule
gagtgaaaa

SEQ ID NO: 4747 - DNA, 9 bp, Artificial Sequence
  Synthetic nucleic acid molecule
gagggaaga

SEQ ID NO: 4748 - DNA, 9 bp, Artificial Sequence
  Synthetic nucleic acid molecule
gagtgagtg

SEQ ID NO: 4749 - DNA, 9 bp, Artificial Sequence
  Synthetic nucleic acid molecule
aagtgtgga

SEQ ID NO: 4750 - DNA, 9 bp, Artificial Sequence
  Synthetic nucleic acid molecule
aagagagga

SEQ ID NO: 4751 - DNA, 9 bp, Artificial Sequence
  Synthetic nucleic acid molecule
aagagagga

SEQ ID NO: 4752 - DNA, 9 bp, Artificial Sequence
  Synthetic nucleic acid molecule
aagagagga

SEQ ID NO: 4753 - DNA, 9 bp, Artificial Sequence
  Synthetic nucleic acid molecule
gagagagga

SEQ ID NO: 4754 - DNA, 9 bp, Artificial Sequence
  Synthetic nucleic acid molecule
gagagagga

SEQ ID NO: 4755 - DNA, 9 bp, Artificial Sequence
  Synthetic nucleic acid molecule
tagtgagga

SEQ ID NO: 4756 - DNA, 9 bp, Artificial Sequence
  Synthetic nucleic acid molecule
gagtgagca

SEQ ID NO: 4757 - DNA, 9 bp, Artificial Sequence
  Synthetic nucleic acid molecule
tagtgagga

SEQ ID NO: 4758 - DNA, 9 bp, Artificial Sequence
  Synthetic nucleic acid molecule
gtgtgagga

SEQ ID NO: 4759 - DNA, 9 bp, Artificial Sequence
  Synthetic nucleic acid molecule
gagtgaggg

SEQ ID NO: 4760 - DNA, 9 bp, Artificial Sequence
  Synthetic nucleic acid molecule
gagagagga

SEQ ID NO: 4761 - DNA, 9 bp, Artificial Sequence
  Synthetic nucleic acid molecule
cagtgagga

SEQ ID NO: 4762 - DNA, 9 bp, Artificial Sequence
  Synthetic nucleic acid molecule
gagtgaaga

SEQ ID NO: 4763 - DNA, 9 bp, Artificial Sequence
  Synthetic nucleic acid molecule
gagtgtgga

SEQ ID NO: 4764 - DNA, 9 bp, Artificial Sequence
  Synthetic nucleic acid molecule
gagggagga

SEQ ID NO: 4765 - DNA, 9 bp, Artificial Sequence
  Synthetic nucleic acid molecule
gtgtgagga

SEQ ID NO: 4766 - DNA, 9 bp, Artificial Sequence
  Synthetic nucleic acid molecule
gagagagga

SEQ ID NO: 4767 - DNA, 9 bp, Artificial Sequence
  Synthetic nucleic acid molecule
gagtgagaa

SEQ ID NO: 4768 - DNA, 9 bp, Artificial Sequence
  Synthetic nucleic acid molecule
gagtgggga

SEQ ID NO: 4769 - DNA, 9 bp, Artificial Sequence
  Synthetic nucleic acid molecule
cagtgagga

SEQ ID NO: 4770 - DNA, 9 bp, Artificial Sequence
  Synthetic nucleic acid molecule
cagtgagga

SEQ ID NO: 4771 - DNA, 9 bp, Artificial Sequence
  Synthetic nucleic acid molecule
gagtgagta

SEQ ID NO: 4772 - DNA, 9 bp, Artificial Sequence
  Synthetic nucleic acid molecule
gggtgagga

SEQ ID NO: 4773 - DNA, 9 bp, Artificial Sequence
  Synthetic nucleic acid molecule
gagagagga

SEQ ID NO: 4774 - DNA, 9 bp, Artificial Sequence
  Synthetic nucleic acid molecule
gagtgaggg

SEQ ID NO: 4775 - DNA, 9 bp, Artificial Sequence
  Synthetic nucleic acid molecule
aagtgagga

SEQ ID NO: 4776 - DNA, 9 bp, Artificial Sequence
  Synthetic nucleic acid molecule
gagtcagga

SEQ ID NO: 4777 - DNA, 9 bp, Artificial Sequence
  Synthetic nucleic acid molecule
gagtgaggt

SEQ ID NO: 4778 - DNA, 9 bp, Artificial Sequence
  Synthetic nucleic acid molecule
gagtgtgga

SEQ ID NO: 4779 - DNA, 9 bp, Artificial Sequence
  Synthetic nucleic acid molecule
gagtgagta

SEQ ID NO: 4780 - DNA, 9 bp, Artificial Sequence
  Synthetic nucleic acid molecule
aagtgagga

SEQ ID NO: 4781 - DNA, 9 bp, Artificial Sequence
  Synthetic nucleic acid molecule
aagtgagga

SEQ ID NO: 4782 - DNA, 9 bp, Artificial Sequence
  Synthetic nucleic acid molecule
gagcgagga

SEQ ID NO: 4783 - DNA, 9 bp, Artificial Sequence
  Synthetic nucleic acid molecule
gagtgaggg

SEQ ID NO: 4784 - DNA, 9 bp, Artificial Sequence
  Synthetic nucleic acid molecule
gagggagga

SEQ ID NO: 4785 - DNA, 9 bp, Artificial Sequence
  Synthetic nucleic acid molecule
gagtgaggg

SEQ ID NO: 4786 - DNA, 9 bp, Artificial Sequence
  Synthetic nucleic acid molecule
gagtgaaga

SEQ ID NO: 4787 - DNA, 9 bp, Artificial Sequence
  Synthetic nucleic acid molecule
gagtgaggg

SEQ ID NO: 4788 - DNA, 9 bp, Artificial Sequence
  Synthetic nucleic acid molecule
gagtgaggg

SEQ ID NO: 4789 - DNA, 9 bp, Artificial Sequence
  Synthetic nucleic acid molecule
gagtgaggg

SEQ ID NO: 4790 - DNA, 9 bp, Artificial Sequence
  Synthetic nucleic acid molecule
gagtgaggg

SEQ ID NO: 4791 - DNA, 9 bp, Artificial Sequence
  Synthetic nucleic acid molecule
gagtgaggg

SEQ ID NO: 4792 - DNA, 9 bp, Artificial Sequence
  Synthetic nucleic acid molecule
gagtgaggg

SEQ ID NO: 4793 - DNA, 9 bp, Artificial Sequence
  Synthetic nucleic acid molecule
gagtgagaa

SEQ ID NO: 4794 - DNA, 9 bp, Artificial Sequence
  Synthetic nucleic acid molecule
gagcgagga

SEQ ID NO: 4795 - DNA, 9 bp, Artificial Sequence
  Synthetic nucleic acid molecule
tagtgagga

SEQ ID NO: 4796 - DNA, 9 bp, Artificial Sequence
  Synthetic nucleic acid molecule
aagtgagga

SEQ ID NO: 4797 - DNA, 9 bp, Artificial Sequence
  Synthetic nucleic acid molecule
aagtgagga

SEQ ID NO: 4798 - DNA, 9 bp, Artificial Sequence
  Synthetic nucleic acid molecule
gagggagga

SEQ ID NO: 4799 - DNA, 9 bp, Artificial Sequence
  Synthetic nucleic acid molecule
gagtgaggg

SEQ ID NO: 4800 - DNA, 9 bp, Artificial Sequence
  Synthetic nucleic acid molecule
gagagagga

SEQ ID NO: 4801 - DNA, 9 bp, Artificial Sequence
  Synthetic nucleic acid molecule
tagtgagga

SEQ ID NO: 4802 - DNA, 9 bp, Artificial Sequence
  Synthetic nucleic acid molecule
gagtaagga

SEQ ID NO: 4803 - DNA, 9 bp, Artificial Sequence
  Synthetic nucleic acid molecule
gagtgtgga

SEQ ID NO: 4804 - DNA, 9 bp, Artificial Sequence
  Synthetic nucleic acid molecule
gagggagga

SEQ ID NO: 4805 - DNA, 9 bp, Artificial Sequence
  Synthetic nucleic acid molecule
tagtgagga

SEQ ID NO: 4806 - DNA, 9 bp, Artificial Sequence
  Synthetic nucleic acid molecule
gagggagga

SEQ ID NO: 4807 - DNA, 9 bp, Artificial Sequence
  Synthetic nucleic acid molecule
gagtgaaga

SEQ ID NO: 4808 - DNA, 9 bp, Artificial Sequence
  Synthetic nucleic acid molecule
gagtgaggg

SEQ ID NO: 4809 - DNA, 9 bp, Artificial Sequence
  Synthetic nucleic acid molecule
gagtgaggg

SEQ ID NO: 4810 - DNA, 9 bp, Artificial Sequence
  Synthetic nucleic acid molecule
gtgtgagga

SEQ ID NO: 4811 - DNA, 9 bp, Artificial Sequence
  Synthetic nucleic acid molecule
gagtaagga

SEQ ID NO: 4812 - DNA, 9 bp, Artificial Sequence
  Synthetic nucleic acid molecule
gagtgaggg

SEQ ID NO: 4813 - DNA, 9 bp, Artificial Sequence
  Synthetic nucleic acid molecule
cagtgagga

SEQ ID NO: 4814 - DNA, 9 bp, Artificial Sequence
  Synthetic nucleic acid molecule
gggtgagga

SEQ ID NO: 4815 - DNA, 9 bp, Artificial Sequence
  Synthetic nucleic acid molecule
gagtgaggg

SEQ ID NO: 4816 - DNA, 9 bp, Artificial Sequence
  Synthetic nucleic acid molecule
gggtgagga

SEQ ID NO: 4817 - DNA, 9 bp, Artificial Sequence
  Synthetic nucleic acid molecule
gagtgagca

SEQ ID NO: 4818 - DNA, 9 bp, Artificial Sequence
  Synthetic nucleic acid molecule
gagagagga

SEQ ID NO: 4819 - DNA, 9 bp, Artificial Sequence
  Synthetic nucleic acid molecule
gaatgagga

SEQ ID NO: 4820 - DNA, 9 bp, Artificial Sequence
  Synthetic nucleic acid molecule
gagtgaggg

SEQ ID NO: 4821 - DNA, 9 bp, Artificial Sequence
  Synthetic nucleic acid molecule
aagtgagga

SEQ ID NO: 4822 - DNA, 9 bp, Artificial Sequence
  Synthetic nucleic acid molecule
cagtgagga

SEQ ID NO: 4823 - DNA, 9 bp, Artificial Sequence
  Synthetic nucleic acid molecule
gagttagga

SEQ ID NO: 4824 - DNA, 9 bp, Artificial Sequence
  Synthetic nucleic acid molecule
gaatgagga

SEQ ID NO: 4825 - DNA, 9 bp, Artificial Sequence
  Synthetic nucleic acid molecule
gagggagga

SEQ ID NO: 4826 - DNA, 9 bp, Artificial Sequence
  Synthetic nucleic acid molecule
gagtgaaga

SEQ ID NO: 4827 - DNA, 9 bp, Artificial Sequence
  Synthetic nucleic acid molecule
gagtcagga

SEQ ID NO: 4828 - DNA, 9 bp, Artificial Sequence
  Synthetic nucleic acid molecule
gagtgaggg

SEQ ID NO: 4829 - DNA, 9 bp, Artificial Sequence
  Synthetic nucleic acid molecule
gagtgagca

SEQ ID NO: 4830 - DNA, 9 bp, Artificial Sequence
  Synthetic nucleic acid molecule
aagtgagga

SEQ ID NO: 4831 - DNA, 9 bp, Artificial Sequence
  Synthetic nucleic acid molecule
gtgtgagga

SEQ ID NO: 4832 - DNA, 9 bp, Artificial Sequence
  Synthetic nucleic acid molecule
gagtgaggc

SEQ ID NO: 4833 - DNA, 9 bp, Artificial Sequence
  Synthetic nucleic acid molecule
cagtgagga

SEQ ID NO: 4834 - DNA, 9 bp, Artificial Sequence
  Synthetic nucleic acid molecule
aagtgagga

SEQ ID NO: 4835 - DNA, 9 bp, Artificial Sequence
  Synthetic nucleic acid molecule
aagtgagga

SEQ ID NO: 4836 - DNA, 9 bp, Artificial Sequence
  Synthetic nucleic acid molecule
gagggagga

SEQ ID NO: 4837 - DNA, 9 bp, Artificial Sequence
  Synthetic nucleic acid molecule
gagtgagaa

SEQ ID NO: 4838 - DNA, 9 bp, Artificial Sequence
  Synthetic nucleic acid molecule
gggtgagga

SEQ ID NO: 4839 - DNA, 9 bp, Artificial Sequence
  Synthetic nucleic acid molecule
gagtgacga

SEQ ID NO: 4840 - DNA, 9 bp, Artificial Sequence
  Synthetic nucleic acid molecule
aagtgagga

SEQ ID NO: 4841 - DNA, 9 bp, Artificial Sequence
  Synthetic nucleic acid molecule
gagagagga

SEQ ID NO: 4842 - DNA, 9 bp, Artificial Sequence
  Synthetic nucleic acid molecule
gagtgagaa

SEQ ID NO: 4843 - DNA, 9 bp, Artificial Sequence
  Synthetic nucleic acid molecule
tagtgagga

SEQ ID NO: 4844 - DNA, 9 bp, Artificial Sequence
  Synthetic nucleic acid molecule
gagtgagca

SEQ ID NO: 4845 - DNA, 9 bp, Artificial Sequence
  Synthetic nucleic acid molecule
aagtgagga

SEQ ID NO: 4846 - DNA, 9 bp, Artificial Sequence
  Synthetic nucleic acid molecule
tagtgagga

SEQ ID NO: 4847 - DNA, 9 bp, Artificial Sequence
  Synthetic nucleic acid molecule
gagtgaggg

SEQ ID NO: 4848 - DNA, 9 bp, Artificial Sequence
  Synthetic nucleic acid molecule
gggtgagga

SEQ ID NO: 4849 - DNA, 9 bp, Artificial Sequence
  Synthetic nucleic acid molecule
gggtgagga

SEQ ID NO: 4850 - DNA, 9 bp, Artificial Sequence
  Synthetic nucleic acid molecule
gagtgagta

SEQ ID NO: 4851 - DNA, 9 bp, Artificial Sequence
  Synthetic nucleic acid molecule
gtgtgagga

SEQ ID NO: 4852 - DNA, 9 bp, Artificial Sequence
  Synthetic nucleic acid molecule
aagtgagga

SEQ ID NO: 4853 - DNA, 9 bp, Artificial Sequence
  Synthetic nucleic acid molecule
gagggagga

SEQ ID NO: 4854 - DNA, 9 bp, Artificial Sequence
  Synthetic nucleic acid molecule
gagagagga

SEQ ID NO: 4855 - DNA, 9 bp, Artificial Sequence
  Synthetic nucleic acid molecule
gagtgagaa

SEQ ID NO: 4856 - DNA, 9 bp, Artificial Sequence
  Synthetic nucleic acid molecule
gggtgagga

SEQ ID NO: 4857 - DNA, 9 bp, Artificial Sequence
  Synthetic nucleic acid molecule
gagtgagca

SEQ ID NO: 4858 - DNA, 9 bp, Artificial Sequence
  Synthetic nucleic acid molecule
gggtgagga

SEQ ID NO: 4859 - DNA, 9 bp, Artificial Sequence
  Synthetic nucleic acid molecule
gagtgagca

SEQ ID NO: 4860 - DNA, 9 bp, Artificial Sequence
  Synthetic nucleic acid molecule
aagtgagga

SEQ ID NO: 4861 - DNA, 9 bp, Artificial Sequence
  Synthetic nucleic acid molecule
gagtgagta

SEQ ID NO: 4862 - DNA, 9 bp, Artificial Sequence
  Synthetic nucleic acid molecule
tagtgagga

SEQ ID NO: 4863 - DNA, 9 bp, Artificial Sequence
  Synthetic nucleic acid molecule
gagagagga

SEQ ID NO: 4864 - DNA, 9 bp, Artificial Sequence
  Synthetic nucleic acid molecule
cagtgagga

SEQ ID NO: 4865 - DNA, 9 bp, Artificial Sequence
  Synthetic nucleic acid molecule
gtgtgagga

SEQ ID NO: 4866 - DNA, 9 bp, Artificial Sequence
  Synthetic nucleic acid molecule
gagtgaaga

SEQ ID NO: 4867 - DNA, 9 bp, Artificial Sequence
  Synthetic nucleic acid molecule
gagtgatga

SEQ ID NO: 4868 - DNA, 9 bp, Artificial Sequence
  Synthetic nucleic acid molecule
gagtgagaa

SEQ ID NO: 4869 - DNA, 9 bp, Artificial Sequence
  Synthetic nucleic acid molecule
aagtgagga

SEQ ID NO: 4870 - DNA, 9 bp, Artificial Sequence
  Synthetic nucleic acid molecule
gagggagga

SEQ ID NO: 4871 - DNA, 9 bp, Artificial Sequence
  Synthetic nucleic acid molecule
gagtgaggc

SEQ ID NO: 4872 - DNA, 9 bp, Artificial Sequence
  Synthetic nucleic acid molecule
gagtgaggg

SEQ ID NO: 4873 - DNA, 9 bp, Artificial Sequence
  Synthetic nucleic acid molecule
gagtgaggg

SEQ ID NO: 4874 - DNA, 9 bp, Artificial Sequence
  Synthetic nucleic acid molecule
tagtgagga

SEQ ID NO: 4875 - DNA, 9 bp, Artificial Sequence
  Synthetic nucleic acid molecule
gactgagga

SEQ ID NO: 4876 - DNA, 9 bp, Artificial Sequence
  Synthetic nucleic acid molecule
gagtgagaa

SEQ ID NO: 4877 - DNA, 9 bp, Artificial Sequence
  Synthetic nucleic acid molecule
gagggagga

SEQ ID NO: 4878 - DNA, 9 bp, Artificial Sequence
  Synthetic nucleic acid molecule
gagtgatga

SEQ ID NO: 4879 - DNA, 9 bp, Artificial Sequence
  Synthetic nucleic acid molecule
gagtgaggg

SEQ ID NO: 4880 - DNA, 9 bp, Artificial Sequence
  Synthetic nucleic acid molecule
gagagagga

SEQ ID NO: 4881 - DNA, 9 bp, Artificial Sequence
  Synthetic nucleic acid molecule
gagtgagaa

SEQ ID NO: 4882 - DNA, 9 bp, Artificial Sequence
  Synthetic nucleic acid molecule
cagtgagga

SEQ ID NO: 4883 - DNA, 9 bp, Artificial Sequence
  Synthetic nucleic acid molecule
gagtgtgga

SEQ ID NO: 4884 - DNA, 9 bp, Artificial Sequence
  Synthetic nucleic acid molecule
aagtgagga

SEQ ID NO: 4885 - DNA, 9 bp, Artificial Sequence
  Synthetic nucleic acid molecule
gagagagga

SEQ ID NO: 4886 - DNA, 9 bp, Artificial Sequence
  Synthetic nucleic acid molecule
aagtgagga

SEQ ID NO: 4887 - DNA, 9 bp, Artificial Sequence
  Synthetic nucleic acid molecule
gagggagga

SEQ ID NO: 4888 - DNA, 9 bp, Artificial Sequence
  Synthetic nucleic acid molecule
gggtgagga

SEQ ID NO: 4889 - DNA, 9 bp, Artificial Sequence
  Synthetic nucleic acid molecule
aagtgagga

SEQ ID NO: 4890 - DNA, 9 bp, Artificial Sequence
  Synthetic nucleic acid molecule
aagtgagga

SEQ ID NO: 4891 - DNA, 9 bp, Artificial Sequence
  Synthetic nucleic acid molecule
aagtgagga

SEQ ID NO: 4892 - DNA, 9 bp, Artificial Sequence
  Synthetic nucleic acid molecule
aagtgagga

SEQ ID NO: 4893 - DNA, 9 bp, Artificial Sequence
  Synthetic nucleic acid molecule
tagtgagga

SEQ ID NO: 4894 - DNA, 9 bp, Artificial Sequence
  Synthetic nucleic acid molecule
gggtgagga

SEQ ID NO: 4895 - DNA, 9 bp, Artificial Sequence
  Synthetic nucleic acid molecule
gagggagga

SEQ ID NO: 4896 - DNA, 9 bp, Artificial Sequence
  Synthetic nucleic acid molecule
gagggagga

SEQ ID NO: 4897 - DNA, 9 bp, Artificial Sequence
  Synthetic nucleic acid molecule
gagggagga

SEQ ID NO: 4898 - DNA, 9 bp, Artificial Sequence
  Synthetic nucleic acid molecule
gagagagga

SEQ ID NO: 4899 - DNA, 9 bp, Artificial Sequence
  Synthetic nucleic acid molecule
aagtgagga

SEQ ID NO: 4900 - DNA, 9 bp, Artificial Sequence
  Synthetic nucleic acid molecule
aagtgagga

SEQ ID NO: 4901 - DNA, 9 bp, Artificial Sequence
  Synthetic nucleic acid molecule
gagtgtgga

SEQ ID NO: 4902 - DNA, 9 bp, Artificial Sequence
  Synthetic nucleic acid molecule
gagggagga

SEQ ID NO: 4903 - DNA, 9 bp, Artificial Sequence
  Synthetic nucleic acid molecule
gagcgagga

SEQ ID NO: 4904 - DNA, 9 bp, Artificial Sequence
  Synthetic nucleic acid molecule
gagtgaggt

SEQ ID NO: 4905 - DNA, 9 bp, Artificial Sequence
  Synthetic nucleic acid molecule
cagtgagga

SEQ ID NO: 4906 - DNA, 9 bp, Artificial Sequence
  Synthetic nucleic acid molecule
gagtgagta

SEQ ID NO: 4907 - DNA, 9 bp, Artificial Sequence
  Synthetic nucleic acid molecule
gagggagga

SEQ ID NO: 4908 - DNA, 9 bp, Artificial Sequence
  Synthetic nucleic acid molecule
gggtgagga

SEQ ID NO: 4909 - DNA, 9 bp, Artificial Sequence
  Synthetic nucleic acid molecule
tagtgagga

SEQ ID NO: 4910 - DNA, 9 bp, Artificial Sequence
  Synthetic nucleic acid molecule
aagtgagga

SEQ ID NO: 4911 - DNA, 9 bp, Artificial Sequence
  Synthetic nucleic acid molecule
gagtgggga

SEQ ID NO: 4912 - DNA, 9 bp, Artificial Sequence
  Synthetic nucleic acid molecule
gagtgagca

SEQ ID NO: 4913 - DNA, 9 bp, Artificial Sequence
  Synthetic nucleic acid molecule
gagtgagga

SEQ ID NO: 4914 - DNA, 9 bp, Artificial Sequence
  Synthetic nucleic acid molecule
gagtgagga

SEQ ID NO: 4915 - DNA, 9 bp, Artificial Sequence
  Synthetic nucleic acid molecule
gagtgagga

SEQ ID NO: 4916 - DNA, 9 bp, Artificial Sequence
  Synthetic nucleic acid molecule
gagtgagga

SEQ ID NO: 4917 - DNA, 9 bp, Artificial Sequence
  Synthetic nucleic acid molecule
gagtgagga

SEQ ID NO: 4918 - DNA, 9 bp, Artificial Sequence
  Synthetic nucleic acid molecule
gagtgagga

SEQ ID NO: 4919 - DNA, 9 bp, Artificial Sequence
  Synthetic nucleic acid molecule
gagtgagga

SEQ ID NO: 4920 - DNA, 9 bp, Artificial Sequence
  Synthetic nucleic acid molecule
gagtgagga

SEQ ID NO: 4921 - DNA, 9 bp, Artificial Sequence
  Synthetic nucleic acid molecule
gagtgagga

SEQ ID NO: 4922 - DNA, 9 bp, Artificial Sequence
  Synthetic nucleic acid molecule
gagtgagga

SEQ ID NO: 4923 - DNA, 9 bp, Artificial Sequence
  Synthetic nucleic acid molecule
gagtgagga

SEQ ID NO: 4924 - DNA, 9 bp, Artificial Sequence
  Synthetic nucleic acid molecule
gagtgagga

SEQ ID NO: 4925 - DNA, 9 bp, Artificial Sequence
  Synthetic nucleic acid molecule
gagtgagga

SEQ ID NO: 4926 - DNA, 9 bp, Artificial Sequence
  Synthetic nucleic acid molecule
gagtgagga

SEQ ID NO: 4927 - DNA, 9 bp, Artificial Sequence
  Synthetic nucleic acid molecule
gagtgagga

SEQ ID NO: 4928 - DNA, 9 bp, Artificial Sequence
  Synthetic nucleic acid molecule
gagtgagga

SEQ ID NO: 4929 - DNA, 9 bp, Artificial Sequence
  Synthetic nucleic acid molecule
gagtgagga

SEQ ID NO: 4930 - DNA, 9 bp, Artificial Sequence
  Synthetic nucleic acid molecule
gagtgagga

SEQ ID NO: 4931 - DNA, 9 bp, Artificial Sequence
  Synthetic nucleic acid molecule
gagtgagga

SEQ ID NO: 4932 - DNA, 9 bp, Artificial Sequence
  Synthetic nucleic acid molecule
gagtgagga

SEQ ID NO: 4933 - DNA, 9 bp, Artificial Sequence
  Synthetic nucleic acid molecule
gagtgagga

SEQ ID NO: 4934 - DNA, 9 bp, Artificial Sequence
  Synthetic nucleic acid molecule
gagtgagga

SEQ ID NO: 4935 - DNA, 9 bp, Artificial Sequence
  Synthetic nucleic acid molecule
gagtgagga

SEQ ID NO: 4936 - DNA, 9 bp, Artificial Sequence
  Synthetic nucleic acid molecule
gagtgagga

SEQ ID NO: 4937 - DNA, 9 bp, Artificial Sequence
  Synthetic nucleic acid molecule
gagtgagga

SEQ ID NO: 4938 - DNA, 9 bp, Artificial Sequence
  Synthetic nucleic acid molecule
gagtgagga

SEQ ID NO: 4939 - DNA, 9 bp, Artificial Sequence
  Synthetic nucleic acid molecule
gagtgagga

SEQ ID NO: 4940 - DNA, 9 bp, Artificial Sequence
  Synthetic nucleic acid molecule
gagtgagga

SEQ ID NO: 4941 - DNA, 9 bp, Artificial Sequence
  Synthetic nucleic acid molecule
gagtgagga

SEQ ID NO: 4942 - DNA, 9 bp, Artificial Sequence
  Synthetic nucleic acid molecule
gagtgagga

SEQ ID NO: 4943 - DNA, 9 bp, Artificial Sequence
  Synthetic nucleic acid molecule
gagtgagga

SEQ ID NO: 4944 - DNA, 9 bp, Artificial Sequence
  Synthetic nucleic acid molecule
gagtgagga

SEQ ID NO: 4945 - DNA, 9 bp, Artificial Sequence
  Synthetic nucleic acid molecule
gagtgagga

SEQ ID NO: 4946 - DNA, 9 bp, Artificial Sequence
  Synthetic nucleic acid molecule
gagtgagga

SEQ ID NO: 4947 - DNA, 9 bp, Artificial Sequence
  Synthetic nucleic acid molecule
gagtgagga

SEQ ID NO: 4948 - DNA, 9 bp, Artificial Sequence
  Synthetic nucleic acid molecule
gagtgagga

SEQ ID NO: 4949 - DNA, 9 bp, Artificial Sequence
  Synthetic nucleic acid molecule
gagtgagga

SEQ ID NO: 4950 - DNA, 9 bp, Artificial Sequence
  Synthetic nucleic acid molecule
gagtgagga

SEQ ID NO: 4951 - DNA, 9 bp, Artificial Sequence
  Synthetic nucleic acid molecule
gagtgagga

SEQ ID NO: 4952 - DNA, 9 bp, Artificial Sequence
  Synthetic nucleic acid molecule
gagtgagga

SEQ ID NO: 4953 - DNA, 9 bp, Artificial Sequence
  Synthetic nucleic acid molecule
gagtgagga

SEQ ID NO: 4954 - DNA, 9 bp, Artificial Sequence
  Synthetic nucleic acid molecule
gagtgagga

SEQ ID NO: 4955 - DNA, 9 bp, Artificial Sequence
  Synthetic nucleic acid molecule
gagtgagga

SEQ ID NO: 4956 - DNA, 9 bp, Artificial Sequence
  Synthetic nucleic acid molecule
gagtgagga

SEQ ID NO: 4957 - DNA, 9 bp, Artificial Sequence
  Synthetic nucleic acid molecule
gagtgagga

SEQ ID NO: 4958 - DNA, 9 bp, Artificial Sequence
  Synthetic nucleic acid molecule
gagtgagga

SEQ ID NO: 4959 - DNA, 9 bp, Artificial Sequence
  Synthetic nucleic acid molecule
gagtgagga

SEQ ID NO: 4960 - DNA, 9 bp, Artificial Sequence
  Synthetic nucleic acid molecule
gagtgagga

SEQ ID NO: 4961 - DNA, 9 bp, Artificial Sequence
  Synthetic nucleic acid molecule
gagtgagga

SEQ ID NO: 4962 - DNA, 9 bp, Artificial Sequence
  Synthetic nucleic acid molecule
gagtgagga

SEQ ID NO: 4963 - DNA, 9 bp, Artificial Sequence
  Synthetic nucleic acid molecule
gagtgagga

SEQ ID NO: 4964 - DNA, 9 bp, Artificial Sequence
  Synthetic nucleic acid molecule
gagtgagga

SEQ ID NO: 4965 - DNA, 9 bp, Artificial Sequence
  Synthetic nucleic acid molecule
gagtgagga

SEQ ID NO: 4966 - DNA, 9 bp, Artificial Sequence
  Synthetic nucleic acid molecule
gagtgagga

SEQ ID NO: 4967 - DNA, 9 bp, Artificial Sequence
  Synthetic nucleic acid molecule
gagtgagga

SEQ ID NO: 4968 - DNA, 9 bp, Artificial Sequence
  Synthetic nucleic acid molecule
gagtgagga

SEQ ID NO: 4969 - DNA, 9 bp, Artificial Sequence
  Synthetic nucleic acid molecule
gagtgagga

SEQ ID NO: 4970 - DNA, 9 bp, Artificial Sequence
  Synthetic nucleic acid molecule
gagtgagga

SEQ ID NO: 4971 - DNA, 9 bp, Artificial Sequence
  Synthetic nucleic acid molecule
gagtgagga

SEQ ID NO: 4972 - DNA, 9 bp, Artificial Sequence
  Synthetic nucleic acid molecule
gagtgagga

SEQ ID NO: 4973 - DNA, 9 bp, Artificial Sequence
  Synthetic nucleic acid molecule
gagtgagga

SEQ ID NO: 4974 - DNA, 9 bp, Artificial Sequence
  Synthetic nucleic acid molecule
gagtgagga

SEQ ID NO: 4975 - DNA, 9 bp, Artificial Sequence
  Synthetic nucleic acid molecule
gagtgagga

SEQ ID NO: 4976 - DNA, 9 bp, Artificial Sequence
  Synthetic nucleic acid molecule
gagtgagga

SEQ ID NO: 4977 - DNA, 9 bp, Artificial Sequence
  Synthetic nucleic acid molecule
gagtgagga

SEQ ID NO: 4978 - DNA, 9 bp, Artificial Sequence
  Synthetic nucleic acid molecule
gagtgagga

SEQ ID NO: 4979 - DNA, 9 bp, Artificial Sequence
  Synthetic nucleic acid molecule
gagtgagga

SEQ ID NO: 4980 - DNA, 9 bp, Artificial Sequence
  Synthetic nucleic acid molecule
gagtgagga

SEQ ID NO: 4981 - DNA, 9 bp, Artificial Sequence
  Synthetic nucleic acid molecule
gagtgagga

SEQ ID NO: 4982 - DNA, 9 bp, Artificial Sequence
  Synthetic nucleic acid molecule
gagtgagga

SEQ ID NO: 4983 - DNA, 9 bp, Artificial Sequence
  Synthetic nucleic acid molecule
gagtgagga

SEQ ID NO: 4984 - DNA, 9 bp, Artificial Sequence
  Synthetic nucleic acid molecule
gagtgagga

SEQ ID NO: 4985 - DNA, 9 bp, Artificial Sequence
  Synthetic nucleic acid molecule
gagtgagga

SEQ ID NO: 4986 - DNA, 9 bp, Artificial Sequence
  Synthetic nucleic acid molecule
gagtgagga

SEQ ID NO: 4987 - DNA, 9 bp, Artificial Sequence
  Synthetic nucleic acid molecule
gagtgagga

SEQ ID NO: 4988 - DNA, 9 bp, Artificial Sequence
  Synthetic nucleic acid molecule
gagtgagga

SEQ ID NO: 4989 - DNA, 9 bp, Artificial Sequence
  Synthetic nucleic acid molecule
gagtgagga

SEQ ID NO: 4990 - DNA, 9 bp, Artificial Sequence
  Synthetic nucleic acid molecule
gagtgagga

SEQ ID NO: 4991 - DNA, 9 bp, Artificial Sequence
  Synthetic nucleic acid molecule
gagtgagga

SEQ ID NO: 4992 - DNA, 9 bp, Artificial Sequence
  Synthetic nucleic acid molecule
gagtgagga

SEQ ID NO: 4993 - DNA, 9 bp, Artificial Sequence
  Synthetic nucleic acid molecule
gagtgagga

SEQ ID NO: 4994 - DNA, 9 bp, Artificial Sequence
  Synthetic nucleic acid molecule
gagtgagga

SEQ ID NO: 4995 - DNA, 9 bp, Artificial Sequence
  Synthetic nucleic acid molecule
gagtgagga

SEQ ID NO: 4996 - DNA, 9 bp, Artificial Sequence
  Synthetic nucleic acid molecule
gagtgagga

SEQ ID NO: 4997 - DNA, 9 bp, Artificial Sequence
  Synthetic nucleic acid molecule
gagtgagga

SEQ ID NO: 4998 - DNA, 9 bp, Artificial Sequence
  Synthetic nucleic acid molecule
gagtgagga

SEQ ID NO: 4999 - DNA, 9 bp, Artificial Sequence
  Synthetic nucleic acid molecule
gagtgagga

SEQ ID NO: 5000 - DNA, 9 bp, Artificial Sequence
  Synthetic nucleic acid molecule
gagtgagga

SEQ ID NO: 5001 - DNA, 9 bp, Artificial Sequence
  Synthetic nucleic acid molecule
gagtgagga

SEQ ID NO: 5002 - DNA, 9 bp, Artificial Sequence
  Synthetic nucleic acid molecule
gagtgagga

SEQ ID NO: 5003 - DNA, 9 bp, Artificial Sequence
  Synthetic nucleic acid molecule
gagtgagga

SEQ ID NO: 5004 - DNA, 9 bp, Artificial Sequence
  Synthetic nucleic acid molecule
gagtgagga

SEQ ID NO: 5005 - DNA, 9 bp, Artificial Sequence
  Synthetic nucleic acid molecule
gagtgagga

SEQ ID NO: 5006 - DNA, 9 bp, Artificial Sequence
  Synthetic nucleic acid molecule
gagtgagga

SEQ ID NO: 5007 - DNA, 9 bp, Artificial Sequence
  Synthetic nucleic acid molecule
gagtgagga

SEQ ID NO: 5008 - DNA, 9 bp, Artificial Sequence
  Synthetic nucleic acid molecule
gagtgagga

SEQ ID NO: 5009 - DNA, 9 bp, Artificial Sequence
  Synthetic nucleic acid molecule
gagtgagga

SEQ ID NO: 5010 - DNA, 9 bp, Artificial Sequence
  Synthetic nucleic acid molecule
gagtgagga

SEQ ID NO: 5011 - DNA, 9 bp, Artificial Sequence
  Synthetic nucleic acid molecule
gagtgagga

SEQ ID NO: 5012 - DNA, 9 bp, Artificial Sequence
  Synthetic nucleic acid molecule
gagtgagga

SEQ ID NO: 5013 - DNA, 9 bp, Artificial Sequence
  Synthetic nucleic acid molecule
gagtgagga

SEQ ID NO: 5014 - DNA, 9 bp, Artificial Sequence
  Synthetic nucleic acid molecule
gagtgagga

SEQ ID NO: 5015 - DNA, 9 bp, Artificial Sequence
  Synthetic nucleic acid molecule
gagtgagga

SEQ ID NO: 5016 - DNA, 9 bp, Artificial Sequence
  Synthetic nucleic acid molecule
gagtgagga

SEQ ID NO: 5017 - DNA, 9 bp, Artificial Sequence
  Synthetic nucleic acid molecule
gagtgagga

SEQ ID NO: 5018 - DNA, 9 bp, Artificial Sequence
  Synthetic nucleic acid molecule
gagtgagga

SEQ ID NO: 5019 - DNA, 9 bp, Artificial Sequence
  Synthetic nucleic acid molecule
gagtgagga

SEQ ID NO: 5020 - DNA, 9 bp, Artificial Sequence
  Synthetic nucleic acid molecule
gagtgagga

SEQ ID NO: 5021 - DNA, 9 bp, Artificial Sequence
  Synthetic nucleic acid molecule
gagtgagga

SEQ ID NO: 5022 - DNA, 9 bp, Artificial Sequence
  Synthetic nucleic acid molecule
gactcatgt

SEQ ID NO: 5023 - DNA, 9 bp, Artificial Sequence
  Synthetic nucleic acid molecule
tagtggagc

SEQ ID NO: 5024 - DNA, 9 bp, Artificial Sequence
  Synthetic nucleic acid molecule
gtgggagtc

SEQ ID NO: 5025 - DNA, 9 bp, Artificial Sequence
  Synthetic nucleic acid molecule
ggcggaggc

SEQ ID NO: 5026 - DNA, 9 bp, Artificial Sequence
  Synthetic nucleic acid molecule
aggtgacaa

SEQ ID NO: 5027 - DNA, 9 bp, Artificial Sequence
  Synthetic nucleic acid molecule
gggagacca

SEQ ID NO: 5028 - DNA, 9 bp, Artificial Sequence
  Synthetic nucleic acid molecule
aagacatga

SEQ ID NO: 5029 - DNA, 9 bp, Artificial Sequence
  Synthetic nucleic acid molecule
catggagca

SEQ ID NO: 5030 - DNA, 9 bp, Artificial Sequence
  Synthetic nucleic acid molecule
cagtgaaac

SEQ ID NO: 5031 - DNA, 9 bp, Artificial Sequence
  Synthetic nucleic acid molecule
gtgtgctgc

SEQ ID NO: 5032 - DNA, 9 bp, Artificial Sequence
  Synthetic nucleic acid molecule
ggtagagca

SEQ ID NO: 5033 - DNA, 9 bp, Artificial Sequence
  Synthetic nucleic acid molecule
catggagca

SEQ ID NO: 5034 - DNA, 9 bp, Artificial Sequence
  Synthetic nucleic acid molecule
agggcagga

SEQ ID NO: 5035 - DNA, 9 bp, Artificial Sequence
  Synthetic nucleic acid molecule
gagcgcgtc

SEQ ID NO: 5036 - DNA, 9 bp, Artificial Sequence
  Synthetic nucleic acid molecule
ggctgagat

SEQ ID NO: 5037 - DNA, 9 bp, Artificial Sequence
  Synthetic nucleic acid molecule
gtgggagcc

SEQ ID NO: 5038 - DNA, 9 bp, Artificial Sequence
  Synthetic nucleic acid molecule
tggtaagca

SEQ ID NO: 5039 - DNA, 9 bp, Artificial Sequence
  Synthetic nucleic acid molecule
gtgtgttgc

SEQ ID NO: 5040 - DNA, 9 bp, Artificial Sequence
  Synthetic nucleic acid molecule
aattgagtt

SEQ ID NO: 5041 - DNA, 9 bp, Artificial Sequence
  Synthetic nucleic acid molecule
gtgagttga

SEQ ID NO: 5042 - DNA, 9 bp, Artificial Sequence
  Synthetic nucleic acid molecule
gtgtgctgc

SEQ ID NO: 5043 - DNA, 9 bp, Artificial Sequence
  Synthetic nucleic acid molecule
gactgccgt

SEQ ID NO: 5044 - DNA, 9 bp, Artificial Sequence
  Synthetic nucleic acid molecule
catggagca

SEQ ID NO: 5045 - DNA, 9 bp, Artificial Sequence
  Synthetic nucleic acid molecule
gagcggtgc

SEQ ID NO: 5046 - DNA, 9 bp, Artificial Sequence
  Synthetic nucleic acid molecule
ggcagaggt

SEQ ID NO: 5047 - DNA, 9 bp, Artificial Sequence
  Synthetic nucleic acid molecule
ccgctagga

SEQ ID NO: 5048 - DNA, 9 bp, Artificial Sequence
  Synthetic nucleic acid molecule
gagggcggc

SEQ ID NO: 5049 - DNA, 9 bp, Artificial Sequence
  Synthetic nucleic acid molecule
gtgtgaagg

SEQ ID NO: 5050 - DNA, 9 bp, Artificial Sequence
  Synthetic nucleic acid molecule
aagtgagcc

SEQ ID NO: 5051 - DNA, 9 bp, Artificial Sequence
  Synthetic nucleic acid molecule
cagtgaaaa

SEQ ID NO: 5052 - DNA, 9 bp, Artificial Sequence
  Synthetic nucleic acid molecule
cagtgtggt

SEQ ID NO: 5053 - DNA, 9 bp, Artificial Sequence
  Synthetic nucleic acid molecule
gagcctgga

SEQ ID NO: 5054 - DNA, 9 bp, Artificial Sequence
  Synthetic nucleic acid molecule
gtgtgagag

SEQ ID NO: 5055 - DNA, 9 bp, Artificial Sequence
  Synthetic nucleic acid molecule
gagaggggc

SEQ ID NO: 5056 - DNA, 9 bp, Artificial Sequence
  Synthetic nucleic acid molecule
gtctcagga

SEQ ID NO: 5057 - DNA, 9 bp, Artificial Sequence
  Synthetic nucleic acid molecule
gtctcagga

SEQ ID NO: 5058 - DNA, 9 bp, Artificial Sequence
  Synthetic nucleic acid molecule
gtgtgagtg

SEQ ID NO: 5059 - DNA, 9 bp, Artificial Sequence
  Synthetic nucleic acid molecule
gtctcagga

SEQ ID NO: 5060 - DNA, 9 bp, Artificial Sequence
  Synthetic nucleic acid molecule
gagtgatat

SEQ ID NO: 5061 - DNA, 9 bp, Artificial Sequence
  Synthetic nucleic acid molecule
gtgtaaggt

SEQ ID NO: 5062 - DNA, 9 bp, Artificial Sequence
  Synthetic nucleic acid molecule
gtctcagga

SEQ ID NO: 5063 - DNA, 9 bp, Artificial Sequence
  Synthetic nucleic acid molecule
gtctcagga

SEQ ID NO: 5064 - DNA, 9 bp, Artificial Sequence
  Synthetic nucleic acid molecule
tggtgaggg

SEQ ID NO: 5065 - DNA, 9 bp, Artificial Sequence
  Synthetic nucleic acid molecule
gtctcagga

SEQ ID NO: 5066 - DNA, 9 bp, Artificial Sequence
  Synthetic nucleic acid molecule
ctgtgaggc

SEQ ID NO: 5067 - DNA, 9 bp, Artificial Sequence
  Synthetic nucleic acid molecule
gagggcggc

SEQ ID NO: 5068 - DNA, 9 bp, Artificial Sequence
  Synthetic nucleic acid molecule
gagagagcc

SEQ ID NO: 5069 - DNA, 9 bp, Artificial Sequence
  Synthetic nucleic acid molecule
ttgtgaggg

SEQ ID NO: 5070 - DNA, 9 bp, Artificial Sequence
  Synthetic nucleic acid molecule
gtctcagga

SEQ ID NO: 5071 - DNA, 9 bp, Artificial Sequence
  Synthetic nucleic acid molecule
gtctcagga

SEQ ID NO: 5072 - DNA, 9 bp, Artificial Sequence
  Synthetic nucleic acid molecule
tagtgagtc

SEQ ID NO: 5073 - DNA, 9 bp, Artificial Sequence
  Synthetic nucleic acid molecule
tggtgaggc

SEQ ID NO: 5074 - DNA, 9 bp, Artificial Sequence
  Synthetic nucleic acid molecule
gtctcagga

SEQ ID NO: 5075 - DNA, 9 bp, Artificial Sequence
  Synthetic nucleic acid molecule
gaggaaggg

SEQ ID NO: 5076 - DNA, 9 bp, Artificial Sequence
  Synthetic nucleic acid molecule
gagcaagaa

SEQ ID NO: 5077 - DNA, 9 bp, Artificial Sequence
  Synthetic nucleic acid molecule
aagtgtggt

SEQ ID NO: 5078 - DNA, 9 bp, Artificial Sequence
  Synthetic nucleic acid molecule
gtctcagga

SEQ ID NO: 5079 - DNA, 9 bp, Artificial Sequence
  Synthetic nucleic acid molecule
ggttgaggc

SEQ ID NO: 5080 - DNA, 9 bp, Artificial Sequence
  Synthetic nucleic acid molecule
gggagaggc

SEQ ID NO: 5081 - DNA, 9 bp, Artificial Sequence
  Synthetic nucleic acid molecule
ggaggagga

SEQ ID NO: 5082 - DNA, 9 bp, Artificial Sequence
  Synthetic nucleic acid molecule
gtctcagga

SEQ ID NO: 5083 - DNA, 9 bp, Artificial Sequence
  Synthetic nucleic acid molecule
gactgaaca

SEQ ID NO: 5084 - DNA, 9 bp, Artificial Sequence
  Synthetic nucleic acid molecule
gagggagcc

SEQ ID NO: 5085 - DNA, 9 bp, Artificial Sequence
  Synthetic nucleic acid molecule
aagggaggt

SEQ ID NO: 5086 - DNA, 9 bp, Artificial Sequence
  Synthetic nucleic acid molecule
gagtgtcgt

SEQ ID NO: 5087 - DNA, 9 bp, Artificial Sequence
  Synthetic nucleic acid molecule
gtgtgagct

SEQ ID NO: 5088 - DNA, 9 bp, Artificial Sequence
  Synthetic nucleic acid molecule
gagtgaaag

SEQ ID NO: 5089 - DNA, 9 bp, Artificial Sequence
  Synthetic nucleic acid molecule
aggtgaggt

SEQ ID NO: 5090 - DNA, 9 bp, Artificial Sequence
  Synthetic nucleic acid molecule
ggaggagga

SEQ ID NO: 5091 - DNA, 9 bp, Artificial Sequence
  Synthetic nucleic acid molecule
gtgggaggt

SEQ ID NO: 5092 - DNA, 9 bp, Artificial Sequence
  Synthetic nucleic acid molecule
tggtgaggc

SEQ ID NO: 5093 - DNA, 9 bp, Artificial Sequence
  Synthetic nucleic acid molecule
gagagatgg

SEQ ID NO: 5094 - DNA, 9 bp, Artificial Sequence
  Synthetic nucleic acid molecule
gtctcagga

SEQ ID NO: 5095 - DNA, 9 bp, Artificial Sequence
  Synthetic nucleic acid molecule
gagttgaga

SEQ ID NO: 5096 - DNA, 9 bp, Artificial Sequence
  Synthetic nucleic acid molecule
aattgagca

SEQ ID NO: 5097 - DNA, 9 bp, Artificial Sequence
  Synthetic nucleic acid molecule
gagtaggca

SEQ ID NO: 5098 - DNA, 9 bp, Artificial Sequence
  Synthetic nucleic acid molecule
tagggaggt

SEQ ID NO: 5099 - DNA, 9 bp, Artificial Sequence
  Synthetic nucleic acid molecule
ggaggagga

SEQ ID NO: 5100 - DNA, 9 bp, Artificial Sequence
  Synthetic nucleic acid molecule
gagtgaatt

SEQ ID NO: 5101 - DNA, 9 bp, Artificial Sequence
  Synthetic nucleic acid molecule
gtctcagga

SEQ ID NO: 5102 - DNA, 9 bp, Artificial Sequence
  Synthetic nucleic acid molecule
gactgagtc

SEQ ID NO: 5103 - DNA, 9 bp, Artificial Sequence
  Synthetic nucleic acid molecule
gagggagat

SEQ ID NO: 5104 - DNA, 9 bp, Artificial Sequence
  Synthetic nucleic acid molecule
gtatgaggc

SEQ ID NO: 5105 - DNA, 9 bp, Artificial Sequence
  Synthetic nucleic acid molecule
tggtgaggc

SEQ ID NO: 5106 - DNA, 9 bp, Artificial Sequence
  Synthetic nucleic acid molecule
gtctcagga

SEQ ID NO: 5107 - DNA, 9 bp, Artificial Sequence
  Synthetic nucleic acid molecule
gtctcagga

SEQ ID NO: 5108 - DNA, 9 bp, Artificial Sequence
  Synthetic nucleic acid molecule
gtctcagga

SEQ ID NO: 5109 - DNA, 9 bp, Artificial Sequence
  Synthetic nucleic acid molecule
gagtgattt

SEQ ID NO: 5110 - DNA, 9 bp, Artificial Sequence
  Synthetic nucleic acid molecule
gagtgaatt

SEQ ID NO: 5111 - DNA, 9 bp, Artificial Sequence
  Synthetic nucleic acid molecule
gtctcagga

SEQ ID NO: 5112 - DNA, 9 bp, Artificial Sequence
  Synthetic nucleic acid molecule
gtctcagga

SEQ ID NO: 5113 - DNA, 9 bp, Artificial Sequence
  Synthetic nucleic acid molecule
gagtaggca

SEQ ID NO: 5114 - DNA, 9 bp, Artificial Sequence
  Synthetic nucleic acid molecule
gagtaagct

SEQ ID NO: 5115 - DNA, 9 bp, Artificial Sequence
  Synthetic nucleic acid molecule
gtctcagga

SEQ ID NO: 5116 - DNA, 9 bp, Artificial Sequence
  Synthetic nucleic acid molecule
gtctcagga

SEQ ID NO: 5117 - DNA, 9 bp, Artificial Sequence
  Synthetic nucleic acid molecule
gggagtgga

SEQ ID NO: 5118 - DNA, 9 bp, Artificial Sequence
  Synthetic nucleic acid molecule
gagggaaaa

SEQ ID NO: 5119 - DNA, 9 bp, Artificial Sequence
  Synthetic nucleic acid molecule
aggtgagaa

SEQ ID NO: 5120 - DNA, 9 bp, Artificial Sequence
  Synthetic nucleic acid molecule
aagtgtggt

SEQ ID NO: 5121 - DNA, 9 bp, Artificial Sequence
  Synthetic nucleic acid molecule
aggtgagaa

SEQ ID NO: 5122 - DNA, 9 bp, Artificial Sequence
  Synthetic nucleic acid molecule
cagagaggt

SEQ ID NO: 5123 - DNA, 9 bp, Artificial Sequence
  Synthetic nucleic acid molecule
aagagaggg

SEQ ID NO: 5124 - DNA, 9 bp, Artificial Sequence
  Synthetic nucleic acid molecule
gtgtgagag

SEQ ID NO: 5125 - DNA, 9 bp, Artificial Sequence
  Synthetic nucleic acid molecule
aggtgagaa

SEQ ID NO: 5126 - DNA, 9 bp, Artificial Sequence
  Synthetic nucleic acid molecule
aggtgagaa

SEQ ID NO: 5127 - DNA, 9 bp, Artificial Sequence
  Synthetic nucleic acid molecule
aggtgagaa

SEQ ID NO: 5128 - DNA, 9 bp, Artificial Sequence
  Synthetic nucleic acid molecule
aggtgagaa

SEQ ID NO: 5129 - DNA, 9 bp, Artificial Sequence
  Synthetic nucleic acid molecule
gaggaaggg

SEQ ID NO: 5130 - DNA, 9 bp, Artificial Sequence
  Synthetic nucleic acid molecule
gtctcagga

SEQ ID NO: 5131 - DNA, 9 bp, Artificial Sequence
  Synthetic nucleic acid molecule
gggtgaagc

SEQ ID NO: 5132 - DNA, 9 bp, Artificial Sequence
  Synthetic nucleic acid molecule
gtctcagga

SEQ ID NO: 5133 - DNA, 9 bp, Artificial Sequence
  Synthetic nucleic acid molecule
gagtgaatt

SEQ ID NO: 5134 - DNA, 9 bp, Artificial Sequence
  Synthetic nucleic acid molecule
gtctcagga

SEQ ID NO: 5135 - DNA, 9 bp, Artificial Sequence
  Synthetic nucleic acid molecule
gtctcagga

SEQ ID NO: 5136 - DNA, 9 bp, Artificial Sequence
  Synthetic nucleic acid molecule
gggtgagtg

SEQ ID NO: 5137 - DNA, 9 bp, Artificial Sequence
  Synthetic nucleic acid molecule
gtgtggggt

SEQ ID NO: 5138 - DNA, 9 bp, Artificial Sequence
  Synthetic nucleic acid molecule
tagtgttga

SEQ ID NO: 5139 - DNA, 9 bp, Artificial Sequence
  Synthetic nucleic acid molecule
gaataaaga

SEQ ID NO: 5140 - DNA, 9 bp, Artificial Sequence
  Synthetic nucleic acid molecule
gtctcagga

SEQ ID NO: 5141 - DNA, 9 bp, Artificial Sequence
  Synthetic nucleic acid molecule
gggagtgga

SEQ ID NO: 5142 - DNA, 9 bp, Artificial Sequence
  Synthetic nucleic acid molecule
gaggaaggc

SEQ ID NO: 5143 - DNA, 9 bp, Artificial Sequence
  Synthetic nucleic acid molecule
gtctcagga

SEQ ID NO: 5144 - DNA, 9 bp, Artificial Sequence
  Synthetic nucleic acid molecule
aagagtgga

SEQ ID NO: 5145 - DNA, 9 bp, Artificial Sequence
  Synthetic nucleic acid molecule
aagtgagcc

SEQ ID NO: 5146 - DNA, 9 bp, Artificial Sequence
  Synthetic nucleic acid molecule
gagtaggca

SEQ ID NO: 5147 - DNA, 9 bp, Artificial Sequence
  Synthetic nucleic acid molecule
ctgtgaggc

SEQ ID NO: 5148 - DNA, 9 bp, Artificial Sequence
  Synthetic nucleic acid molecule
gtctcagga

SEQ ID NO: 5149 - DNA, 9 bp, Artificial Sequence
  Synthetic nucleic acid molecule
gtctcagga

SEQ ID NO: 5150 - DNA, 9 bp, Artificial Sequence
  Synthetic nucleic acid molecule
cagtgagat

SEQ ID NO: 5151 - DNA, 9 bp, Artificial Sequence
  Synthetic nucleic acid molecule
gaggaaaga

SEQ ID NO: 5152 - DNA, 9 bp, Artificial Sequence
  Synthetic nucleic acid molecule
aagtgagtc

SEQ ID NO: 5153 - DNA, 9 bp, Artificial Sequence
  Synthetic nucleic acid molecule
gagtgattt

SEQ ID NO: 5154 - DNA, 9 bp, Artificial Sequence
  Synthetic nucleic acid molecule
gtttcagga

SEQ ID NO: 5155 - DNA, 9 bp, Artificial Sequence
  Synthetic nucleic acid molecule
gtttcagga

SEQ ID NO: 5156 - DNA, 9 bp, Artificial Sequence
  Synthetic nucleic acid molecule
gaggtaggc

SEQ ID NO: 5157 - DNA, 9 bp, Artificial Sequence
  Synthetic nucleic acid molecule
tagtgagac

SEQ ID NO: 5158 - DNA, 9 bp, Artificial Sequence
  Synthetic nucleic acid molecule
gtctcagga

SEQ ID NO: 5159 - DNA, 9 bp, Artificial Sequence
  Synthetic nucleic acid molecule
gagtgggct

SEQ ID NO: 5160 - DNA, 9 bp, Artificial Sequence
  Synthetic nucleic acid molecule
gagcaggga

SEQ ID NO: 5161 - DNA, 9 bp, Artificial Sequence
  Synthetic nucleic acid molecule
tggtgaggg

SEQ ID NO: 5162 - DNA, 9 bp, Artificial Sequence
  Synthetic nucleic acid molecule
gagtgttgg

SEQ ID NO: 5163 - DNA, 9 bp, Artificial Sequence
  Synthetic nucleic acid molecule
tagtgtggt

SEQ ID NO: 5164 - DNA, 9 bp, Artificial Sequence
  Synthetic nucleic acid molecule
gtgtgagat

SEQ ID NO: 5165 - DNA, 9 bp, Artificial Sequence
  Synthetic nucleic acid molecule
gagggaggg

SEQ ID NO: 5166 - DNA, 9 bp, Artificial Sequence
  Synthetic nucleic acid molecule
gagtgagat

SEQ ID NO: 5167 - DNA, 9 bp, Artificial Sequence
  Synthetic nucleic acid molecule
gagagaggc

SEQ ID NO: 5168 - DNA, 9 bp, Artificial Sequence
  Synthetic nucleic acid molecule
gagtgagcc

SEQ ID NO: 5169 - DNA, 9 bp, Artificial Sequence
  Synthetic nucleic acid molecule
gagtaaggt

SEQ ID NO: 5170 - DNA, 9 bp, Artificial Sequence
  Synthetic nucleic acid molecule
aagtgagta

SEQ ID NO: 5171 - DNA, 9 bp, Artificial Sequence
  Synthetic nucleic acid molecule
gagggaggc

SEQ ID NO: 5172 - DNA, 9 bp, Artificial Sequence
  Synthetic nucleic acid molecule
gagtgtggg

SEQ ID NO: 5173 - DNA, 9 bp, Artificial Sequence
  Synthetic nucleic acid molecule
cagtgaggg

SEQ ID NO: 5174 - DNA, 9 bp, Artificial Sequence
  Synthetic nucleic acid molecule
tagtgaggg

SEQ ID NO: 5175 - DNA, 9 bp, Artificial Sequence
  Synthetic nucleic acid molecule
gagtaaggt

SEQ ID NO: 5176 - DNA, 9 bp, Artificial Sequence
  Synthetic nucleic acid molecule
gggtgaggg

SEQ ID NO: 5177 - DNA, 9 bp, Artificial Sequence
  Synthetic nucleic acid molecule
gagtgagat

SEQ ID NO: 5178 - DNA, 9 bp, Artificial Sequence
  Synthetic nucleic acid molecule
cagtgaggg

SEQ ID NO: 5179 - DNA, 9 bp, Artificial Sequence
  Synthetic nucleic acid molecule
gagtgagtc

SEQ ID NO: 5180 - DNA, 9 bp, Artificial Sequence
  Synthetic nucleic acid molecule
gagtgaaaa

SEQ ID NO: 5181 - DNA, 9 bp, Artificial Sequence
  Synthetic nucleic acid molecule
gagggaggt

SEQ ID NO: 5182 - DNA, 9 bp, Artificial Sequence
  Synthetic nucleic acid molecule
gagtgtgaa

SEQ ID NO: 5183 - DNA, 9 bp, Artificial Sequence
  Synthetic nucleic acid molecule
gagcgagta

SEQ ID NO: 5184 - DNA, 9 bp, Artificial Sequence
  Synthetic nucleic acid molecule
gtgtgaggc

SEQ ID NO: 5185 - DNA, 9 bp, Artificial Sequence
  Synthetic nucleic acid molecule
gagggaggc

SEQ ID NO: 5186 - DNA, 9 bp, Artificial Sequence
  Synthetic nucleic acid molecule
tagtgaggc

SEQ ID NO: 5187 - DNA, 9 bp, Artificial Sequence
  Synthetic nucleic acid molecule
cagtgaggg

SEQ ID NO: 5188 - DNA, 9 bp, Artificial Sequence
  Synthetic nucleic acid molecule
gagtgagat

SEQ ID NO: 5189 - DNA, 9 bp, Artificial Sequence
  Synthetic nucleic acid molecule
tagtgaggg

SEQ ID NO: 5190 - DNA, 9 bp, Artificial Sequence
  Synthetic nucleic acid molecule
gagtgagag

SEQ ID NO: 5191 - DNA, 9 bp, Artificial Sequence
  Synthetic nucleic acid molecule
gagtgagtg

SEQ ID NO: 5192 - DNA, 9 bp, Artificial Sequence
  Synthetic nucleic acid molecule
gagtgagac

SEQ ID NO: 5193 - DNA, 9 bp, Artificial Sequence
  Synthetic nucleic acid molecule
aagtgaggg

SEQ ID NO: 5194 - DNA, 9 bp, Artificial Sequence
  Synthetic nucleic acid molecule
gagggaggt

SEQ ID NO: 5195 - DNA, 9 bp, Artificial Sequence
  Synthetic nucleic acid molecule
gagggaggt

SEQ ID NO: 5196 - DNA, 9 bp, Artificial Sequence
  Synthetic nucleic acid molecule
gagagaggc

SEQ ID NO: 5197 - DNA, 9 bp, Artificial Sequence
  Synthetic nucleic acid molecule
gagtgaata

SEQ ID NO: 5198 - DNA, 9 bp, Artificial Sequence
  Synthetic nucleic acid molecule
gagtgagag

SEQ ID NO: 5199 - DNA, 9 bp, Artificial Sequence
  Synthetic nucleic acid molecule
gagggaggc

SEQ ID NO: 5200 - DNA, 9 bp, Artificial Sequence
  Synthetic nucleic acid molecule
gagagaggg

SEQ ID NO: 5201 - DNA, 9 bp, Artificial Sequence
  Synthetic nucleic acid molecule
tagtgaggc

SEQ ID NO: 5202 - DNA, 9 bp, Artificial Sequence
  Synthetic nucleic acid molecule
aagtgaggt

SEQ ID NO: 5203 - DNA, 9 bp, Artificial Sequence
  Synthetic nucleic acid molecule
gagggaggc

SEQ ID NO: 5204 - DNA, 9 bp, Artificial Sequence
  Synthetic nucleic acid molecule
gagtgtggt

SEQ ID NO: 5205 - DNA, 9 bp, Artificial Sequence
  Synthetic nucleic acid molecule
gagtgagat

SEQ ID NO: 5206 - DNA, 9 bp, Artificial Sequence
  Synthetic nucleic acid molecule
gggtgaggt

SEQ ID NO: 5207 - DNA, 9 bp, Artificial Sequence
  Synthetic nucleic acid molecule
gagtgagcc

SEQ ID NO: 5208 - DNA, 9 bp, Artificial Sequence
  Synthetic nucleic acid molecule
gagtgagcc

SEQ ID NO: 5209 - DNA, 9 bp, Artificial Sequence
  Synthetic nucleic acid molecule
gggtgaggg

SEQ ID NO: 5210 - DNA, 9 bp, Artificial Sequence
  Synthetic nucleic acid molecule
gagtgagcc

SEQ ID NO: 5211 - DNA, 9 bp, Artificial Sequence
  Synthetic nucleic acid molecule
gtgtgaggc

SEQ ID NO: 5212 - DNA, 9 bp, Artificial Sequence
  Synthetic nucleic acid molecule
gagtgacca

SEQ ID NO: 5213 - DNA, 9 bp, Artificial Sequence
  Synthetic nucleic acid molecule
cagtgaggg

SEQ ID NO: 5214 - DNA, 9 bp, Artificial Sequence
  Synthetic nucleic acid molecule
cagtgaggc

SEQ ID NO: 5215 - DNA, 9 bp, Artificial Sequence
  Synthetic nucleic acid molecule
cagtgaggg

SEQ ID NO: 5216 - DNA, 9 bp, Artificial Sequence
  Synthetic nucleic acid molecule
tagtgaggg

SEQ ID NO: 5217 - DNA, 9 bp, Artificial Sequence
  Synthetic nucleic acid molecule
gagtgatgt

SEQ ID NO: 5218 - DNA, 9 bp, Artificial Sequence
  Synthetic nucleic acid molecule
gagggaggt

SEQ ID NO: 5219 - DNA, 9 bp, Artificial Sequence
  Synthetic nucleic acid molecule
gagagaggg

SEQ ID NO: 5220 - DNA, 9 bp, Artificial Sequence
  Synthetic nucleic acid molecule
aagtgaggg

SEQ ID NO: 5221 - DNA, 9 bp, Artificial Sequence
  Synthetic nucleic acid molecule
gagtgagcc

SEQ ID NO: 5222 - DNA, 9 bp, Artificial Sequence
  Synthetic nucleic acid molecule
gagtgtgaa

SEQ ID NO: 5223 - DNA, 9 bp, Artificial Sequence
  Synthetic nucleic acid molecule
gagtgaagt

SEQ ID NO: 5224 - DNA, 9 bp, Artificial Sequence
  Synthetic nucleic acid molecule
gagggaggc

SEQ ID NO: 5225 - DNA, 9 bp, Artificial Sequence
  Synthetic nucleic acid molecule
gagtgtggc

SEQ ID NO: 5226 - DNA, 9 bp, Artificial Sequence
  Synthetic nucleic acid molecule
gagtggtga

SEQ ID NO: 5227 - DNA, 9 bp, Artificial Sequence
  Synthetic nucleic acid molecule
gtgtgaggc

SEQ ID NO: 5228 - DNA, 9 bp, Artificial Sequence
  Synthetic nucleic acid molecule
aagtgaggg

SEQ ID NO: 5229 - DNA, 9 bp, Artificial Sequence
  Synthetic nucleic acid molecule
gagtgagtg

SEQ ID NO: 5230 - DNA, 9 bp, Artificial Sequence
  Synthetic nucleic acid molecule
aagtgaggg

SEQ ID NO: 5231 - DNA, 9 bp, Artificial Sequence
  Synthetic nucleic acid molecule
cagtgaggg

SEQ ID NO: 5232 - DNA, 9 bp, Artificial Sequence
  Synthetic nucleic acid molecule
gagtgagtt

SEQ ID NO: 5233 - DNA, 9 bp, Artificial Sequence
  Synthetic nucleic acid molecule
gagtgagat

SEQ ID NO: 5234 - DNA, 9 bp, Artificial Sequence
  Synthetic nucleic acid molecule
gagtgagag

SEQ ID NO: 5235 - DNA, 9 bp, Artificial Sequence
  Synthetic nucleic acid molecule
cagtgaggc

SEQ ID NO: 5236 - DNA, 9 bp, Artificial Sequence
  Synthetic nucleic acid molecule
gagggaggt

SEQ ID NO: 5237 - DNA, 9 bp, Artificial Sequence
  Synthetic nucleic acid molecule
gagtgagtg

SEQ ID NO: 5238 - DNA, 9 bp, Artificial Sequence
  Synthetic nucleic acid molecule
gagtgtggg

SEQ ID NO: 5239 - DNA, 9 bp, Artificial Sequence
  Synthetic nucleic acid molecule
cagtgaggg

SEQ ID NO: 5240 - DNA, 9 bp, Artificial Sequence
  Synthetic nucleic acid molecule
gagtgagac

SEQ ID NO: 5241 - DNA, 9 bp, Artificial Sequence
  Synthetic nucleic acid molecule
gagtgtggc

SEQ ID NO: 5242 - DNA, 9 bp, Artificial Sequence
  Synthetic nucleic acid molecule
cagtgaggc

SEQ ID NO: 5243 - DNA, 9 bp, Artificial Sequence
  Synthetic nucleic acid molecule
gagagaggc

SEQ ID NO: 5244 - DNA, 9 bp, Artificial Sequence
  Synthetic nucleic acid molecule
gagagggga

SEQ ID NO: 5245 - DNA, 9 bp, Artificial Sequence
  Synthetic nucleic acid molecule
gagtgagtg

SEQ ID NO: 5246 - DNA, 9 bp, Artificial Sequence
  Synthetic nucleic acid molecule
cagtgagca

SEQ ID NO: 5247 - DNA, 9 bp, Artificial Sequence
  Synthetic nucleic acid molecule
cagtgaggg

SEQ ID NO: 5248 - DNA, 9 bp, Artificial Sequence
  Synthetic nucleic acid molecule
cagtgaggg

SEQ ID NO: 5249 - DNA, 9 bp, Artificial Sequence
  Synthetic nucleic acid molecule
tagtgagta

SEQ ID NO: 5250 - DNA, 9 bp, Artificial Sequence
  Synthetic nucleic acid molecule
gagtgagtg

SEQ ID NO: 5251 - DNA, 9 bp, Artificial Sequence
  Synthetic nucleic acid molecule
aagtgaggg

SEQ ID NO: 5252 - DNA, 9 bp, Artificial Sequence
  Synthetic nucleic acid molecule
gagagaggc

SEQ ID NO: 5253 - DNA, 9 bp, Artificial Sequence
  Synthetic nucleic acid molecule
gtgtgaggc

SEQ ID NO: 5254 - DNA, 9 bp, Artificial Sequence
  Synthetic nucleic acid molecule
gagggaggc

SEQ ID NO: 5255 - DNA, 9 bp, Artificial Sequence
  Synthetic nucleic acid molecule
gagtgatgt

SEQ ID NO: 5256 - DNA, 9 bp, Artificial Sequence
  Synthetic nucleic acid molecule
gagcgaggc

SEQ ID NO: 5257 - DNA, 9 bp, Artificial Sequence
  Synthetic nucleic acid molecule
gagtgtggg

SEQ ID NO: 5258 - DNA, 9 bp, Artificial Sequence
  Synthetic nucleic acid molecule
gagtgagtg

SEQ ID NO: 5259 - DNA, 9 bp, Artificial Sequence
  Synthetic nucleic acid molecule
gagtaaggt

SEQ ID NO: 5260 - DNA, 9 bp, Artificial Sequence
  Synthetic nucleic acid molecule
tagtgaggg

SEQ ID NO: 5261 - DNA, 9 bp, Artificial Sequence
  Synthetic nucleic acid molecule
cagtgaggg

SEQ ID NO: 5262 - DNA, 9 bp, Artificial Sequence
  Synthetic nucleic acid molecule
gagtgagat

SEQ ID NO: 5263 - DNA, 9 bp, Artificial Sequence
  Synthetic nucleic acid molecule
gagtgagat

SEQ ID NO: 5264 - DNA, 9 bp, Artificial Sequence
  Synthetic nucleic acid molecule
aagtgtgga

SEQ ID NO: 5265 - DNA, 9 bp, Artificial Sequence
  Synthetic nucleic acid molecule
gagggaggt

SEQ ID NO: 5266 - DNA, 9 bp, Artificial Sequence
  Synthetic nucleic acid molecule
cagggagga

SEQ ID NO: 5267 - DNA, 9 bp, Artificial Sequence
  Synthetic nucleic acid molecule
aagtgaggc

SEQ ID NO: 5268 - DNA, 9 bp, Artificial Sequence
  Synthetic nucleic acid molecule
aagtgaggc

SEQ ID NO: 5269 - DNA, 9 bp, Artificial Sequence
  Synthetic nucleic acid molecule
aagtgaggc

SEQ ID NO: 5270 - DNA, 9 bp, Artificial Sequence
  Synthetic nucleic acid molecule
gtgtgaggc

SEQ ID NO: 5271 - DNA, 9 bp, Artificial Sequence
  Synthetic nucleic acid molecule
aagtgaggg

SEQ ID NO: 5272 - DNA, 9 bp, Artificial Sequence
  Synthetic nucleic acid molecule
cagtgaggt

SEQ ID NO: 5273 - DNA, 9 bp, Artificial Sequence
  Synthetic nucleic acid molecule
gagtgagag

SEQ ID NO: 5274 - DNA, 9 bp, Artificial Sequence
  Synthetic nucleic acid molecule
gagtaaggc

SEQ ID NO: 5275 - DNA, 9 bp, Artificial Sequence
  Synthetic nucleic acid molecule
aagtgaggt

SEQ ID NO: 5276 - DNA, 9 bp, Artificial Sequence
  Synthetic nucleic acid molecule
gagacagga

SEQ ID NO: 5277 - DNA, 9 bp, Artificial Sequence
  Synthetic nucleic acid molecule
cagtgaggg

SEQ ID NO: 5278 - DNA, 9 bp, Artificial Sequence
  Synthetic nucleic acid molecule
tagtgaggc

SEQ ID NO: 5279 - DNA, 9 bp, Artificial Sequence
  Synthetic nucleic acid molecule
gggtgaggg

SEQ ID NO: 5280 - DNA, 9 bp, Artificial Sequence
  Synthetic nucleic acid molecule
gagtgagat

SEQ ID NO: 5281 - DNA, 9 bp, Artificial Sequence
  Synthetic nucleic acid molecule
gagggaggc

SEQ ID NO: 5282 - DNA, 9 bp, Artificial Sequence
  Synthetic nucleic acid molecule
gagagggga

SEQ ID NO: 5283 - DNA, 9 bp, Artificial Sequence
  Synthetic nucleic acid molecule
gagtgagct

SEQ ID NO: 5284 - DNA, 9 bp, Artificial Sequence
  Synthetic nucleic acid molecule
gagtgagag

SEQ ID NO: 5285 - DNA, 9 bp, Artificial Sequence
  Synthetic nucleic acid molecule
gagtgagat

SEQ ID NO: 5286 - DNA, 9 bp, Artificial Sequence
  Synthetic nucleic acid molecule
gagtgtggc

SEQ ID NO: 5287 - DNA, 9 bp, Artificial Sequence
  Synthetic nucleic acid molecule
tagtgaggc

SEQ ID NO: 5288 - DNA, 9 bp, Artificial Sequence
  Synthetic nucleic acid molecule
aaatgagga

SEQ ID NO: 5289 - DNA, 9 bp, Artificial Sequence
  Synthetic nucleic acid molecule
gagagaggt

SEQ ID NO: 5290 - DNA, 9 bp, Artificial Sequence
  Synthetic nucleic acid molecule
aagtgagta

SEQ ID NO: 5291 - DNA, 9 bp, Artificial Sequence
  Synthetic nucleic acid molecule
gagggaggt

SEQ ID NO: 5292 - DNA, 9 bp, Artificial Sequence
  Synthetic nucleic acid molecule
tagtgaggg

SEQ ID NO: 5293 - DNA, 9 bp, Artificial Sequence
  Synthetic nucleic acid molecule
gtgtgaggc

SEQ ID NO: 5294 - DNA, 9 bp, Artificial Sequence
  Synthetic nucleic acid molecule
gagtgagtt

SEQ ID NO: 5295 - DNA, 9 bp, Artificial Sequence
  Synthetic nucleic acid molecule
cagtgaggg

SEQ ID NO: 5296 - DNA, 9 bp, Artificial Sequence
  Synthetic nucleic acid molecule
gagtgagtc

SEQ ID NO: 5297 - DNA, 9 bp, Artificial Sequence
  Synthetic nucleic acid molecule
gagagaggc

SEQ ID NO: 5298 - DNA, 9 bp, Artificial Sequence
  Synthetic nucleic acid molecule
gggtgaggc

SEQ ID NO: 5299 - DNA, 9 bp, Artificial Sequence
  Synthetic nucleic acid molecule
gtgtgaggg

SEQ ID NO: 5300 - DNA, 9 bp, Artificial Sequence
  Synthetic nucleic acid molecule
gtgtgaggc

SEQ ID NO: 5301 - DNA, 9 bp, Artificial Sequence
  Synthetic nucleic acid molecule
gagtgtggt

SEQ ID NO: 5302 - DNA, 9 bp, Artificial Sequence
  Synthetic nucleic acid molecule
gagtgtgta

SEQ ID NO: 5303 - DNA, 9 bp, Artificial Sequence
  Synthetic nucleic acid molecule
gagggaggt

SEQ ID NO: 5304 - DNA, 9 bp, Artificial Sequence
  Synthetic nucleic acid molecule
gagggaggg

SEQ ID NO: 5305 - DNA, 9 bp, Artificial Sequence
  Synthetic nucleic acid molecule
gagtggggc

SEQ ID NO: 5306 - DNA, 9 bp, Artificial Sequence
  Synthetic nucleic acid molecule
gagtgagag

SEQ ID NO: 5307 - DNA, 9 bp, Artificial Sequence
  Synthetic nucleic acid molecule
gagtgagcg

SEQ ID NO: 5308 - DNA, 9 bp, Artificial Sequence
  Synthetic nucleic acid molecule
cagtgaggc

SEQ ID NO: 5309 - DNA, 9 bp, Artificial Sequence
  Synthetic nucleic acid molecule
gagtgagat

SEQ ID NO: 5310 - DNA, 9 bp, Artificial Sequence
  Synthetic nucleic acid molecule
gagggagaa

SEQ ID NO: 5311 - DNA, 9 bp, Artificial Sequence
  Synthetic nucleic acid molecule
gagtgtgta

SEQ ID NO: 5312 - DNA, 9 bp, Artificial Sequence
  Synthetic nucleic acid molecule
gagggaggg

SEQ ID NO: 5313 - DNA, 9 bp, Artificial Sequence
  Synthetic nucleic acid molecule
gagtgagtt

SEQ ID NO: 5314 - DNA, 9 bp, Artificial Sequence
  Synthetic nucleic acid molecule
gggtgagaa

SEQ ID NO: 5315 - DNA, 9 bp, Artificial Sequence
  Synthetic nucleic acid molecule
gagggaggc

SEQ ID NO: 5316 - DNA, 9 bp, Artificial Sequence
  Synthetic nucleic acid molecule
gagagaggt

SEQ ID NO: 5317 - DNA, 9 bp, Artificial Sequence
  Synthetic nucleic acid molecule
gagggaggt

SEQ ID NO: 5318 - DNA, 9 bp, Artificial Sequence
  Synthetic nucleic acid molecule
aagtgaggc

SEQ ID NO: 5319 - DNA, 9 bp, Artificial Sequence
  Synthetic nucleic acid molecule
gagtgagtg

SEQ ID NO: 5320 - DNA, 9 bp, Artificial Sequence
  Synthetic nucleic acid molecule
gagtgagac

SEQ ID NO: 5321 - DNA, 9 bp, Artificial Sequence
  Synthetic nucleic acid molecule
gagtaaggt

SEQ ID NO: 5322 - DNA, 9 bp, Artificial Sequence
  Synthetic nucleic acid molecule
aagtgaggc

SEQ ID NO: 5323 - DNA, 9 bp, Artificial Sequence
  Synthetic nucleic acid molecule
gagagaggc

SEQ ID NO: 5324 - DNA, 9 bp, Artificial Sequence
  Synthetic nucleic acid molecule
gtgtgaggg

SEQ ID NO: 5325 - DNA, 9 bp, Artificial Sequence
  Synthetic nucleic acid molecule
cagtgaggt

SEQ ID NO: 5326 - DNA, 9 bp, Artificial Sequence
  Synthetic nucleic acid molecule
gggtgaggt

SEQ ID NO: 5327 - DNA, 9 bp, Artificial Sequence
  Synthetic nucleic acid molecule
gagggaggt

SEQ ID NO: 5328 - DNA, 9 bp, Artificial Sequence
  Synthetic nucleic acid molecule
gaatgagca

SEQ ID NO: 5329 - DNA, 9 bp, Artificial Sequence
  Synthetic nucleic acid molecule
gattgaggg

SEQ ID NO: 5330 - DNA, 9 bp, Artificial Sequence
  Synthetic nucleic acid molecule
gagggaggc

SEQ ID NO: 5331 - DNA, 9 bp, Artificial Sequence
  Synthetic nucleic acid molecule
aagtgaggg

SEQ ID NO: 5332 - DNA, 9 bp, Artificial Sequence
  Synthetic nucleic acid molecule
gagtatgga

SEQ ID NO: 5333 - DNA, 9 bp, Artificial Sequence
  Synthetic nucleic acid molecule
cagtgaggt

SEQ ID NO: 5334 - DNA, 9 bp, Artificial Sequence
  Synthetic nucleic acid molecule
tagtgaggc

SEQ ID NO: 5335 - DNA, 9 bp, Artificial Sequence
  Synthetic nucleic acid molecule
gtgtgaggc

SEQ ID NO: 5336 - DNA, 9 bp, Artificial Sequence
  Synthetic nucleic acid molecule
gtgtgaggt

SEQ ID NO: 5337 - DNA, 9 bp, Artificial Sequence
  Synthetic nucleic acid molecule
gtgtgaggc

SEQ ID NO: 5338 - DNA, 9 bp, Artificial Sequence
  Synthetic nucleic acid molecule
aggtgagga

SEQ ID NO: 5339 - DNA, 9 bp, Artificial Sequence
  Synthetic nucleic acid molecule
gagcgaggt

SEQ ID NO: 5340 - DNA, 9 bp, Artificial Sequence
  Synthetic nucleic acid molecule
gggtgaggc

SEQ ID NO: 5341 - DNA, 9 bp, Artificial Sequence
  Synthetic nucleic acid molecule
tagtgaggc

SEQ ID NO: 5342 - DNA, 9 bp, Artificial Sequence
  Synthetic nucleic acid molecule
gcgtgtgga

SEQ ID NO: 5343 - DNA, 9 bp, Artificial Sequence
  Synthetic nucleic acid molecule
gagtgagat

SEQ ID NO: 5344 - DNA, 9 bp, Artificial Sequence
  Synthetic nucleic acid molecule
gagtgagat

SEQ ID NO: 5345 - DNA, 9 bp, Artificial Sequence
  Synthetic nucleic acid molecule
cagtgaggc

SEQ ID NO: 5346 - DNA, 9 bp, Artificial Sequence
  Synthetic nucleic acid molecule
gtgtgaggg

SEQ ID NO: 5347 - DNA, 9 bp, Artificial Sequence
  Synthetic nucleic acid molecule
aagtgaggc

SEQ ID NO: 5348 - DNA, 9 bp, Artificial Sequence
  Synthetic nucleic acid molecule
gtgtgaggg

SEQ ID NO: 5349 - DNA, 9 bp, Artificial Sequence
  Synthetic nucleic acid molecule
tagtgaggc

SEQ ID NO: 5350 - DNA, 9 bp, Artificial Sequence
  Synthetic nucleic acid molecule
gagtgagat

SEQ ID NO: 5351 - DNA, 9 bp, Artificial Sequence
  Synthetic nucleic acid molecule
gagggaggc

SEQ ID NO: 5352 - DNA, 9 bp, Artificial Sequence
  Synthetic nucleic acid molecule
gagtaaggg

SEQ ID NO: 5353 - DNA, 9 bp, Artificial Sequence
  Synthetic nucleic acid molecule
cagtgaggg

SEQ ID NO: 5354 - DNA, 9 bp, Artificial Sequence
  Synthetic nucleic acid molecule
cagtgaggg

SEQ ID NO: 5355 - DNA, 9 bp, Artificial Sequence
  Synthetic nucleic acid molecule
gagtgcaga

SEQ ID NO: 5356 - DNA, 9 bp, Artificial Sequence
  Synthetic nucleic acid molecule
gagtgtgaa

SEQ ID NO: 5357 - DNA, 9 bp, Artificial Sequence
  Synthetic nucleic acid molecule
gagtgagat

SEQ ID NO: 5358 - DNA, 9 bp, Artificial Sequence
  Synthetic nucleic acid molecule
gggtgaggg

SEQ ID NO: 5359 - DNA, 9 bp, Artificial Sequence
  Synthetic nucleic acid molecule
gagtgtgaa

SEQ ID NO: 5360 - DNA, 9 bp, Artificial Sequence
  Synthetic nucleic acid molecule
gagtgagtg

SEQ ID NO: 5361 - DNA, 9 bp, Artificial Sequence
  Synthetic nucleic acid molecule
gagggaggg

SEQ ID NO: 5362 - DNA, 9 bp, Artificial Sequence
  Synthetic nucleic acid molecule
gagggagaa

SEQ ID NO: 5363 - DNA, 9 bp, Artificial Sequence
  Synthetic nucleic acid molecule
gagtgagcc

SEQ ID NO: 5364 - DNA, 9 bp, Artificial Sequence
  Synthetic nucleic acid molecule
gagtgtggt

SEQ ID NO: 5365 - DNA, 9 bp, Artificial Sequence
  Synthetic nucleic acid molecule
gagggaggc

SEQ ID NO: 5366 - DNA, 9 bp, Artificial Sequence
  Synthetic nucleic acid molecule
gagttaggg

SEQ ID NO: 5367 - DNA, 9 bp, Artificial Sequence
  Synthetic nucleic acid molecule
gagagaggc

SEQ ID NO: 5368 - DNA, 9 bp, Artificial Sequence
  Synthetic nucleic acid molecule
gagagaggt

SEQ ID NO: 5369 - DNA, 9 bp, Artificial Sequence
  Synthetic nucleic acid molecule
gggtgaggc

SEQ ID NO: 5370 - DNA, 9 bp, Artificial Sequence
  Synthetic nucleic acid molecule
gagtgagtc

SEQ ID NO: 5371 - DNA, 9 bp, Artificial Sequence
  Synthetic nucleic acid molecule
aagtgaggg

SEQ ID NO: 5372 - DNA, 9 bp, Artificial Sequence
  Synthetic nucleic acid molecule
gagagaggc

SEQ ID NO: 5373 - DNA, 9 bp, Artificial Sequence
  Synthetic nucleic acid molecule
cagtgaggt

SEQ ID NO: 5374 - DNA, 9 bp, Artificial Sequence
  Synthetic nucleic acid molecule
cagtgaggc

SEQ ID NO: 5375 - DNA, 9 bp, Artificial Sequence
  Synthetic nucleic acid molecule
cagtgaggg

SEQ ID NO: 5376 - DNA, 9 bp, Artificial Sequence
  Synthetic nucleic acid molecule
gagtgagtt

SEQ ID NO: 5377 - DNA, 9 bp, Artificial Sequence
  Synthetic nucleic acid molecule
cagtgaggt

SEQ ID NO: 5378 - DNA, 9 bp, Artificial Sequence
  Synthetic nucleic acid molecule
gagtgagcc

SEQ ID NO: 5379 - DNA, 9 bp, Artificial Sequence
  Synthetic nucleic acid molecule
gtgtgaggt

SEQ ID NO: 5380 - DNA, 9 bp, Artificial Sequence
  Synthetic nucleic acid molecule
gagtgagat

SEQ ID NO: 5381 - DNA, 9 bp, Artificial Sequence
  Synthetic nucleic acid molecule
gagggaggc

SEQ ID NO: 5382 - DNA, 9 bp, Artificial Sequence
  Synthetic nucleic acid molecule
aagtgaggg

SEQ ID NO: 5383 - DNA, 9 bp, Artificial Sequence
  Synthetic nucleic acid molecule
gagggaggc

SEQ ID NO: 5384 - DNA, 9 bp, Artificial Sequence
  Synthetic nucleic acid molecule
gagggaggg

SEQ ID NO: 5385 - DNA, 9 bp, Artificial Sequence
  Synthetic nucleic acid molecule
gagtgagag

SEQ ID NO: 5386 - DNA, 9 bp, Artificial Sequence
  Synthetic nucleic acid molecule
gagggaggt

SEQ ID NO: 5387 - DNA, 9 bp, Artificial Sequence
  Synthetic nucleic acid molecule
tagtgaggg

SEQ ID NO: 5388 - DNA, 9 bp, Artificial Sequence
  Synthetic nucleic acid molecule
gagtgaggc

SEQ ID NO: 5389 - DNA, 9 bp, Artificial Sequence
  Synthetic nucleic acid molecule
gagtgaggt

SEQ ID NO: 5390 - DNA, 9 bp, Artificial Sequence
  Synthetic nucleic acid molecule
gtgtgagga

SEQ ID NO: 5391 - DNA, 9 bp, Artificial Sequence
  Synthetic nucleic acid molecule
gagtgaggg

SEQ ID NO: 5392 - DNA, 9 bp, Artificial Sequence
  Synthetic nucleic acid molecule
gagggagga

SEQ ID NO: 5393 - DNA, 9 bp, Artificial Sequence
  Synthetic nucleic acid molecule
gagtgaggt

SEQ ID NO: 5394 - DNA, 9 bp, Artificial Sequence
  Synthetic nucleic acid molecule
gagtgaggt

SEQ ID NO: 5395 - DNA, 9 bp, Artificial Sequence
  Synthetic nucleic acid molecule
gagtgaggc

SEQ ID NO: 5396 - DNA, 9 bp, Artificial Sequence
  Synthetic nucleic acid molecule
gagtgaggg

SEQ ID NO: 5397 - DNA, 9 bp, Artificial Sequence
  Synthetic nucleic acid molecule
gtgtgagga

SEQ ID NO: 5398 - DNA, 9 bp, Artificial Sequence
  Synthetic nucleic acid molecule
gagggagga

SEQ ID NO: 5399 - DNA, 9 bp, Artificial Sequence
  Synthetic nucleic acid molecule
aagtgagga

SEQ ID NO: 5400 - DNA, 9 bp, Artificial Sequence
  Synthetic nucleic acid molecule
gagtgaggg

SEQ ID NO: 5401 - DNA, 9 bp, Artificial Sequence
  Synthetic nucleic acid molecule
gagtaagga

SEQ ID NO: 5402 - DNA, 9 bp, Artificial Sequence
  Synthetic nucleic acid molecule
gagtgaggt

SEQ ID NO: 5403 - DNA, 9 bp, Artificial Sequence
  Synthetic nucleic acid molecule
gagtgaggg

SEQ ID NO: 5404 - DNA, 9 bp, Artificial Sequence
  Synthetic nucleic acid molecule
gagtgaggg

SEQ ID NO: 5405 - DNA, 9 bp, Artificial Sequence
  Synthetic nucleic acid molecule
gagtgaggc

SEQ ID NO: 5406 - DNA, 9 bp, Artificial Sequence
  Synthetic nucleic acid molecule
gagtgaggc

SEQ ID NO: 5407 - DNA, 9 bp, Artificial Sequence
  Synthetic nucleic acid molecule
gagtgggga

SEQ ID NO: 5408 - DNA, 9 bp, Artificial Sequence
  Synthetic nucleic acid molecule
gagtgaggg

SEQ ID NO: 5409 - DNA, 9 bp, Artificial Sequence
  Synthetic nucleic acid molecule
gagtgaggt

SEQ ID NO: 5410 - DNA, 9 bp, Artificial Sequence
  Synthetic nucleic acid molecule
gagtgaggt

SEQ ID NO: 5411 - DNA, 9 bp, Artificial Sequence
  Synthetic nucleic acid molecule
gggtgagga

SEQ ID NO: 5412 - DNA, 9 bp, Artificial Sequence
  Synthetic nucleic acid molecule
gggtgagga

SEQ ID NO: 5413 - DNA, 9 bp, Artificial Sequence
  Synthetic nucleic acid molecule
gagtgaggc

SEQ ID NO: 5414 - DNA, 9 bp, Artificial Sequence
  Synthetic nucleic acid molecule
gagtgaggt

SEQ ID NO: 5415 - DNA, 9 bp, Artificial Sequence
  Synthetic nucleic acid molecule
gagtgaggt

SEQ ID NO: 5416 - DNA, 9 bp, Artificial Sequence
  Synthetic nucleic acid molecule
gagtgaggg

SEQ ID NO: 5417 - DNA, 9 bp, Artificial Sequence
  Synthetic nucleic acid molecule
gagtgaggc

SEQ ID NO: 5418 - DNA, 9 bp, Artificial Sequence
  Synthetic nucleic acid molecule
gagtgaggt

SEQ ID NO: 5419 - DNA, 9 bp, Artificial Sequence
  Synthetic nucleic acid molecule
gagtgaggg

SEQ ID NO: 5420 - DNA, 9 bp, Artificial Sequence
  Synthetic nucleic acid molecule
gagtgaggc

SEQ ID NO: 5421 - DNA, 9 bp, Artificial Sequence
  Synthetic nucleic acid molecule
gggtgagga

SEQ ID NO: 5422 - DNA, 9 bp, Artificial Sequence
  Synthetic nucleic acid molecule
gagtgaggg

SEQ ID NO: 5423 - DNA, 9 bp, Artificial Sequence
  Synthetic nucleic acid molecule
gagtgaggt

SEQ ID NO: 5424 - DNA, 9 bp, Artificial Sequence
  Synthetic nucleic acid molecule
gagtgaggc

SEQ ID NO: 5425 - DNA, 9 bp, Artificial Sequence
  Synthetic nucleic acid molecule
gagtgaggc

SEQ ID NO: 5426 - DNA, 9 bp, Artificial Sequence
  Synthetic nucleic acid molecule
gagtgaggc

SEQ ID NO: 5427 - DNA, 9 bp, Artificial Sequence
  Synthetic nucleic acid molecule
gagtgaggt

SEQ ID NO: 5428 - DNA, 9 bp, Artificial Sequence
  Synthetic nucleic acid molecule
gagtgaggc

SEQ ID NO: 5429 - DNA, 9 bp, Artificial Sequence
  Synthetic nucleic acid molecule
gagtgaggg

SEQ ID NO: 5430 - DNA, 9 bp, Artificial Sequence
  Synthetic nucleic acid molecule
gagtgaggg

SEQ ID NO: 5431 - DNA, 9 bp, Artificial Sequence
  Synthetic nucleic acid molecule
gagtgaggc

SEQ ID NO: 5432 - DNA, 9 bp, Artificial Sequence
  Synthetic nucleic acid molecule
gagggagga

SEQ ID NO: 5433 - DNA, 9 bp, Artificial Sequence
  Synthetic nucleic acid molecule
gagtgaggc

SEQ ID NO: 5434 - DNA, 9 bp, Artificial Sequence
  Synthetic nucleic acid molecule
gagtgaggg

SEQ ID NO: 5435 - DNA, 9 bp, Artificial Sequence
  Synthetic nucleic acid molecule
gagtgaggc

SEQ ID NO: 5436 - DNA, 9 bp, Artificial Sequence
  Synthetic nucleic acid molecule
gagtgaggg

SEQ ID NO: 5437 - DNA, 9 bp, Artificial Sequence
  Synthetic nucleic acid molecule
gagtgaggt

SEQ ID NO: 5438 - DNA, 9 bp, Artificial Sequence
  Synthetic nucleic acid molecule
gagtgaggc

SEQ ID NO: 5439 - DNA, 9 bp, Artificial Sequence
  Synthetic nucleic acid molecule
gagtgagaa

SEQ ID NO: 5440 - DNA, 9 bp, Artificial Sequence
  Synthetic nucleic acid molecule
gagtgaggc

SEQ ID NO: 5441 - DNA, 9 bp, Artificial Sequence
  Synthetic nucleic acid molecule
gagtgaggc

SEQ ID NO: 5442 - DNA, 9 bp, Artificial Sequence
  Synthetic nucleic acid molecule
gtgtgagga

SEQ ID NO: 5443 - DNA, 9 bp, Artificial Sequence
  Synthetic nucleic acid molecule
gagtgaggg

SEQ ID NO: 5444 - DNA, 9 bp, Artificial Sequence
  Synthetic nucleic acid molecule
gagagagga

SEQ ID NO: 5445 - DNA, 9 bp, Artificial Sequence
  Synthetic nucleic acid molecule
gggtgagga

SEQ ID NO: 5446 - DNA, 9 bp, Artificial Sequence
  Synthetic nucleic acid molecule
gagtgaggc

SEQ ID NO: 5447 - DNA, 9 bp, Artificial Sequence
  Synthetic nucleic acid molecule
gagtgaggt

SEQ ID NO: 5448 - DNA, 9 bp, Artificial Sequence
  Synthetic nucleic acid molecule
gagtgaggg

SEQ ID NO: 5449 - DNA, 9 bp, Artificial Sequence
  Synthetic nucleic acid molecule
gagtgaggc

SEQ ID NO: 5450 - DNA, 9 bp, Artificial Sequence
  Synthetic nucleic acid molecule
aagtgagga

SEQ ID NO: 5451 - DNA, 9 bp, Artificial Sequence
  Synthetic nucleic acid molecule
gagtgaggt

SEQ ID NO: 5452 - DNA, 9 bp, Artificial Sequence
  Synthetic nucleic acid molecule
gagtgaggg

SEQ ID NO: 5453 - DNA, 9 bp, Artificial Sequence
  Synthetic nucleic acid molecule
gggtgagga

SEQ ID NO: 5454 - DNA, 9 bp, Artificial Sequence
  Synthetic nucleic acid molecule
tagtgagga

SEQ ID NO: 5455 - DNA, 9 bp, Artificial Sequence
  Synthetic nucleic acid molecule
gggtgagga

SEQ ID NO: 5456 - DNA, 9 bp, Artificial Sequence
  Synthetic nucleic acid molecule
gagtgaggc

SEQ ID NO: 5457 - DNA, 9 bp, Artificial Sequence
  Synthetic nucleic acid molecule
gagtgaggc

SEQ ID NO: 5458 - DNA, 9 bp, Artificial Sequence
  Synthetic nucleic acid molecule
gagtgaggt

SEQ ID NO: 5459 - DNA, 9 bp, Artificial Sequence
  Synthetic nucleic acid molecule
gagtgaggc

SEQ ID NO: 5460 - DNA, 9 bp, Artificial Sequence
  Synthetic nucleic acid molecule
gagtgaggc

SEQ ID NO: 5461 - DNA, 9 bp, Artificial Sequence
  Synthetic nucleic acid molecule
aagtgagga

SEQ ID NO: 5462 - DNA, 9 bp, Artificial Sequence
  Synthetic nucleic acid molecule
gagtgaggc

SEQ ID NO: 5463 - DNA, 9 bp, Artificial Sequence
  Synthetic nucleic acid molecule
gagtaagga

SEQ ID NO: 5464 - DNA, 9 bp, Artificial Sequence
  Synthetic nucleic acid molecule
gagtgaggt

SEQ ID NO: 5465 - DNA, 9 bp, Artificial Sequence
  Synthetic nucleic acid molecule
gagtgaggt

SEQ ID NO: 5466 - DNA, 9 bp, Artificial Sequence
  Synthetic nucleic acid molecule
gagtgagta

SEQ ID NO: 5467 - DNA, 9 bp, Artificial Sequence
  Synthetic nucleic acid molecule
gagtgaggg

SEQ ID NO: 5468 - DNA, 9 bp, Artificial Sequence
  Synthetic nucleic acid molecule
gagtgaggg

SEQ ID NO: 5469 - DNA, 9 bp, Artificial Sequence
  Synthetic nucleic acid molecule
gagtgaggt

SEQ ID NO: 5470 - DNA, 9 bp, Artificial Sequence
  Synthetic nucleic acid molecule
gagtgaggt

SEQ ID NO: 5471 - DNA, 9 bp, Artificial Sequence
  Synthetic nucleic acid molecule
gagtgaggg

SEQ ID NO: 5472 - DNA, 9 bp, Artificial Sequence
  Synthetic nucleic acid molecule
gagtgaggc

SEQ ID NO: 5473 - DNA, 9 bp, Artificial Sequence
  Synthetic nucleic acid molecule
gagtgaggt

SEQ ID NO: 5474 - DNA, 9 bp, Artificial Sequence
  Synthetic nucleic acid molecule
gagtgaggg

SEQ ID NO: 5475 - DNA, 9 bp, Artificial Sequence
  Synthetic nucleic acid molecule
gagtgaggg

SEQ ID NO: 5476 - DNA, 9 bp, Artificial Sequence
  Synthetic nucleic acid molecule
gagtgaggt

SEQ ID NO: 5477 - DNA, 9 bp, Artificial Sequence
  Synthetic nucleic acid molecule
gagtgaggg

SEQ ID NO: 5478 - DNA, 9 bp, Artificial Sequence
  Synthetic nucleic acid molecule
gagtgaggg

SEQ ID NO: 5479 - DNA, 9 bp, Artificial Sequence
  Synthetic nucleic acid molecule
gagtgaggt

SEQ ID NO: 5480 - DNA, 9 bp, Artificial Sequence
  Synthetic nucleic acid molecule
gagtgaggc

SEQ ID NO: 5481 - DNA, 9 bp, Artificial Sequence
  Synthetic nucleic acid molecule
gagtgaggc

SEQ ID NO: 5482 - DNA, 9 bp, Artificial Sequence
  Synthetic nucleic acid molecule
gagtgaggc

SEQ ID NO: 5483 - DNA, 9 bp, Artificial Sequence
  Synthetic nucleic acid molecule
gagtgaggg

SEQ ID NO: 5484 - DNA, 9 bp, Artificial Sequence
  Synthetic nucleic acid molecule
gagtgaggt

SEQ ID NO: 5485 - DNA, 9 bp, Artificial Sequence
  Synthetic nucleic acid molecule
gagtgaggc

SEQ ID NO: 5486 - DNA, 9 bp, Artificial Sequence
  Synthetic nucleic acid molecule
gagtgaggg

SEQ ID NO: 5487 - DNA, 9 bp, Artificial Sequence
  Synthetic nucleic acid molecule
tagtgagga

SEQ ID NO: 5488 - DNA, 9 bp, Artificial Sequence
  Synthetic nucleic acid molecule
gagtgaggt

SEQ ID NO: 5489 - DNA, 9 bp, Artificial Sequence
  Synthetic nucleic acid molecule
gagtgagta

SEQ ID NO: 5490 - DNA, 9 bp, Artificial Sequence
  Synthetic nucleic acid molecule
gagtgaggt

SEQ ID NO: 5491 - DNA, 9 bp, Artificial Sequence
  Synthetic nucleic acid molecule
gagtgaggg

SEQ ID NO: 5492 - DNA, 9 bp, Artificial Sequence
  Synthetic nucleic acid molecule
gagtgaggc

SEQ ID NO: 5493 - DNA, 9 bp, Artificial Sequence
  Synthetic nucleic acid molecule
gagtgaggc

SEQ ID NO: 5494 - DNA, 9 bp, Artificial Sequence
  Synthetic nucleic acid molecule
gagtgaggt

SEQ ID NO: 5495 - DNA, 9 bp, Artificial Sequence
  Synthetic nucleic acid molecule
gagtgaggt

SEQ ID NO: 5496 - DNA, 9 bp, Artificial Sequence
  Synthetic nucleic acid molecule
gagtgaggg

SEQ ID NO: 5497 - DNA, 9 bp, Artificial Sequence
  Synthetic nucleic acid molecule
gagtgaggg

SEQ ID NO: 5498 - DNA, 9 bp, Artificial Sequence
  Synthetic nucleic acid molecule
gagtgaggg

SEQ ID NO: 5499 - DNA, 9 bp, Artificial Sequence
  Synthetic nucleic acid molecule
gagtgaggt

SEQ ID NO: 5500 - DNA, 9 bp, Artificial Sequence
  Synthetic nucleic acid molecule
gagtgaggc

SEQ ID NO: 5501 - DNA, 9 bp, Artificial Sequence
  Synthetic nucleic acid molecule
gagtgaggc

SEQ ID NO: 5502 - DNA, 9 bp, Artificial Sequence
  Synthetic nucleic acid molecule
gagtgaggt

SEQ ID NO: 5503 - DNA, 9 bp, Artificial Sequence
  Synthetic nucleic acid molecule
gagtgaggg

SEQ ID NO: 5504 - DNA, 9 bp, Artificial Sequence
  Synthetic nucleic acid molecule
gagtgaggg

SEQ ID NO: 5505 - DNA, 9 bp, Artificial Sequence
  Synthetic nucleic acid molecule
gagtgaggc

SEQ ID NO: 5506 - DNA, 9 bp, Artificial Sequence
  Synthetic nucleic acid molecule
gagtgaggt

SEQ ID NO: 5507 - DNA, 9 bp, Artificial Sequence
  Synthetic nucleic acid molecule
tagtgagga

SEQ ID NO: 5508 - DNA, 9 bp, Artificial Sequence
  Synthetic nucleic acid molecule
gagtgagta

SEQ ID NO: 5509 - DNA, 9 bp, Artificial Sequence
  Synthetic nucleic acid molecule
gtgtgagga

SEQ ID NO: 5510 - DNA, 9 bp, Artificial Sequence
  Synthetic nucleic acid molecule
gagtgaggg

SEQ ID NO: 5511 - DNA, 9 bp, Artificial Sequence
  Synthetic nucleic acid molecule
gagtgaggg

SEQ ID NO: 5512 - DNA, 9 bp, Artificial Sequence
  Synthetic nucleic acid molecule
gggtgagga

SEQ ID NO: 5513 - DNA, 9 bp, Artificial Sequence
  Synthetic nucleic acid molecule
gggtgagga

SEQ ID NO: 5514 - DNA, 9 bp, Artificial Sequence
  Synthetic nucleic acid molecule
gagtgagaa

SEQ ID NO: 5515 - DNA, 9 bp, Artificial Sequence
  Synthetic nucleic acid molecule
gagtgaggg

SEQ ID NO: 5516 - DNA, 9 bp, Artificial Sequence
  Synthetic nucleic acid molecule
gggtgagga

SEQ ID NO: 5517 - DNA, 9 bp, Artificial Sequence
  Synthetic nucleic acid molecule
gagtgaggg

SEQ ID NO: 5518 - DNA, 9 bp, Artificial Sequence
  Synthetic nucleic acid molecule
gtgtgagga

SEQ ID NO: 5519 - DNA, 9 bp, Artificial Sequence
  Synthetic nucleic acid molecule
gagtgagaa

SEQ ID NO: 5520 - DNA, 9 bp, Artificial Sequence
  Synthetic nucleic acid molecule
gagtgaggg

SEQ ID NO: 5521 - DNA, 9 bp, Artificial Sequence
  Synthetic nucleic acid molecule
gagtgaggg

SEQ ID NO: 5522 - DNA, 9 bp, Artificial Sequence
  Synthetic nucleic acid molecule
gagtgaggc

SEQ ID NO: 5523 - DNA, 9 bp, Artificial Sequence
  Synthetic nucleic acid molecule
gggtgagga

SEQ ID NO: 5524 - DNA, 9 bp, Artificial Sequence
  Synthetic nucleic acid molecule
gagtgaggt

SEQ ID NO: 5525 - DNA, 9 bp, Artificial Sequence
  Synthetic nucleic acid molecule
aagtgagga

SEQ ID NO: 5526 - DNA, 9 bp, Artificial Sequence
  Synthetic nucleic acid molecule
gagtgaggt

SEQ ID NO: 5527 - DNA, 9 bp, Artificial Sequence
  Synthetic nucleic acid molecule
gagggagga

SEQ ID NO: 5528 - DNA, 9 bp, Artificial Sequence
  Synthetic nucleic acid molecule
gagtgaggg

SEQ ID NO: 5529 - DNA, 9 bp, Artificial Sequence
  Synthetic nucleic acid molecule
gagtgaggg

SEQ ID NO: 5530 - DNA, 9 bp, Artificial Sequence
  Synthetic nucleic acid molecule
gagtgaggc

SEQ ID NO: 5531 - DNA, 9 bp, Artificial Sequence
  Synthetic nucleic acid molecule
gggtgagga

SEQ ID NO: 5532 - DNA, 9 bp, Artificial Sequence
  Synthetic nucleic acid molecule
gagtgaggt

SEQ ID NO: 5533 - DNA, 9 bp, Artificial Sequence
  Synthetic nucleic acid molecule
gagtgaggg

SEQ ID NO: 5534 - DNA, 9 bp, Artificial Sequence
  Synthetic nucleic acid molecule
gggtgagga

SEQ ID NO: 5535 - DNA, 9 bp, Artificial Sequence
  Synthetic nucleic acid molecule
gagtgaggc

SEQ ID NO: 5536 - DNA, 9 bp, Artificial Sequence
  Synthetic nucleic acid molecule
gagtgaggg

SEQ ID NO: 5537 - DNA, 9 bp, Artificial Sequence
  Synthetic nucleic acid molecule
gagtgaggc

SEQ ID NO: 5538 - DNA, 9 bp, Artificial Sequence
  Synthetic nucleic acid molecule
gagtgaggg

SEQ ID NO: 5539 - DNA, 9 bp, Artificial Sequence
  Synthetic nucleic acid molecule
gagtgaggc

SEQ ID NO: 5540 - DNA, 9 bp, Artificial Sequence
  Synthetic nucleic acid molecule
gagtgaggc

SEQ ID NO: 5541 - DNA, 9 bp, Artificial Sequence
  Synthetic nucleic acid molecule
gggtgagga

SEQ ID NO: 5542 - DNA, 9 bp, Artificial Sequence
  Synthetic nucleic acid molecule
gagtgaggc

SEQ ID NO: 5543 - DNA, 9 bp, Artificial Sequence
  Synthetic nucleic acid molecule
gagtgaggc

SEQ ID NO: 5544 - DNA, 9 bp, Artificial Sequence
  Synthetic nucleic acid molecule
gagtgaggc

SEQ ID NO: 5545 - DNA, 9 bp, Artificial Sequence
  Synthetic nucleic acid molecule
cagtgagga

SEQ ID NO: 5546 - DNA, 9 bp, Artificial Sequence
  Synthetic nucleic acid molecule
gagtgaggt

SEQ ID NO: 5547 - DNA, 9 bp, Artificial Sequence
  Synthetic nucleic acid molecule
aagtgagga

SEQ ID NO: 5548 - DNA, 9 bp, Artificial Sequence
  Synthetic nucleic acid molecule
tagtgagga

SEQ ID NO: 5549 - DNA, 9 bp, Artificial Sequence
  Synthetic nucleic acid molecule
gagtgagaa

SEQ ID NO: 5550 - DNA, 9 bp, Artificial Sequence
  Synthetic nucleic acid molecule
gagtgaggg

SEQ ID NO: 5551 - DNA, 9 bp, Artificial Sequence
  Synthetic nucleic acid molecule
gagtgaggg

SEQ ID NO: 5552 - DNA, 9 bp, Artificial Sequence
  Synthetic nucleic acid molecule
gagtgaggt

SEQ ID NO: 5553 - DNA, 9 bp, Artificial Sequence
  Synthetic nucleic acid molecule
gagggagga

SEQ ID NO: 5554 - DNA, 9 bp, Artificial Sequence
  Synthetic nucleic acid molecule
gagggagga

SEQ ID NO: 5555 - DNA, 9 bp, Artificial Sequence
  Synthetic nucleic acid molecule
aagtgagga

SEQ ID NO: 5556 - DNA, 9 bp, Artificial Sequence
  Synthetic nucleic acid molecule
gtgtgagga

SEQ ID NO: 5557 - DNA, 9 bp, Artificial Sequence
  Synthetic nucleic acid molecule
gagtgaggc

SEQ ID NO: 5558 - DNA, 9 bp, Artificial Sequence
  Synthetic nucleic acid molecule
gggtgagga

SEQ ID NO: 5559 - DNA, 9 bp, Artificial Sequence
  Synthetic nucleic acid molecule
gagtgaggt

SEQ ID NO: 5560 - DNA, 9 bp, Artificial Sequence
  Synthetic nucleic acid molecule
aagtgagga

SEQ ID NO: 5561 - DNA, 9 bp, Artificial Sequence
  Synthetic nucleic acid molecule
gagtgaggg

SEQ ID NO: 5562 - DNA, 9 bp, Artificial Sequence
  Synthetic nucleic acid molecule
gagtgaggg

SEQ ID NO: 5563 - DNA, 9 bp, Artificial Sequence
  Synthetic nucleic acid molecule
gtgtgagga

SEQ ID NO: 5564 - DNA, 9 bp, Artificial Sequence
  Synthetic nucleic acid molecule
gagtgaggg

SEQ ID NO: 5565 - DNA, 9 bp, Artificial Sequence
  Synthetic nucleic acid molecule
gagtgaggc

SEQ ID NO: 5566 - DNA, 9 bp, Artificial Sequence
  Synthetic nucleic acid molecule
gagtgaggg

SEQ ID NO: 5567 - DNA, 9 bp, Artificial Sequence
  Synthetic nucleic acid molecule
gagtgaggg

SEQ ID NO: 5568 - DNA, 9 bp, Artificial Sequence
  Synthetic nucleic acid molecule
gagtgaggc

SEQ ID NO: 5569 - DNA, 9 bp, Artificial Sequence
  Synthetic nucleic acid molecule
cagtgagga

SEQ ID NO: 5570 - DNA, 9 bp, Artificial Sequence
  Synthetic nucleic acid molecule
gagtgaggc

SEQ ID NO: 5571 - DNA, 9 bp, Artificial Sequence
  Synthetic nucleic acid molecule
gagtgaggt

SEQ ID NO: 5572 - DNA, 9 bp, Artificial Sequence
  Synthetic nucleic acid molecule
gagtgaggg

SEQ ID NO: 5573 - DNA, 9 bp, Artificial Sequence
  Synthetic nucleic acid molecule
gagtgaggc

SEQ ID NO: 5574 - DNA, 9 bp, Artificial Sequence
  Synthetic nucleic acid molecule
gagtgaggg

SEQ ID NO: 5575 - DNA, 9 bp, Artificial Sequence
  Synthetic nucleic acid molecule
gagtgaggt

SEQ ID NO: 5576 - DNA, 9 bp, Artificial Sequence
  Synthetic nucleic acid molecule
gagtgaggg

SEQ ID NO: 5577 - DNA, 9 bp, Artificial Sequence
  Synthetic nucleic acid molecule
gagtgaggc

SEQ ID NO: 5578 - DNA, 9 bp, Artificial Sequence
  Synthetic nucleic acid molecule
gagtgagaa

SEQ ID NO: 5579 - DNA, 9 bp, Artificial Sequence
  Synthetic nucleic acid molecule
gagtgagaa

SEQ ID NO: 5580 - DNA, 9 bp, Artificial Sequence
  Synthetic nucleic acid molecule
gagtgagaa

SEQ ID NO: 5581 - DNA, 9 bp, Artificial Sequence
  Synthetic nucleic acid molecule
gagtgagaa

SEQ ID NO: 5582 - DNA, 9 bp, Artificial Sequence
  Synthetic nucleic acid molecule
gagtgagaa

SEQ ID NO: 5583 - DNA, 9 bp, Artificial Sequence
  Synthetic nucleic acid molecule
gagtgaggt

SEQ ID NO: 5584 - DNA, 9 bp, Artificial Sequence
  Synthetic nucleic acid molecule
gagtgaggt

SEQ ID NO: 5585 - DNA, 9 bp, Artificial Sequence
  Synthetic nucleic acid molecule
gagtgaggg

SEQ ID NO: 5586 - DNA, 9 bp, Artificial Sequence
  Synthetic nucleic acid molecule
gagtgaggg

SEQ ID NO: 5587 - DNA, 9 bp, Artificial Sequence
  Synthetic nucleic acid molecule
gagtgaggt

SEQ ID NO: 5588 - DNA, 9 bp, Artificial Sequence
  Synthetic nucleic acid molecule
gagtgaggg

SEQ ID NO: 5589 - DNA, 9 bp, Artificial Sequence
  Synthetic nucleic acid molecule
gagtgaggt

SEQ ID NO: 5590 - DNA, 9 bp, Artificial Sequence
  Synthetic nucleic acid molecule
gagtgaggg

SEQ ID NO: 5591 - DNA, 9 bp, Artificial Sequence
  Synthetic nucleic acid molecule
gagtgagga

SEQ ID NO: 5592 - DNA, 9 bp, Artificial Sequence
  Synthetic nucleic acid molecule
gagtgagga

SEQ ID NO: 5593 - DNA, 9 bp, Artificial Sequence
  Synthetic nucleic acid molecule
gagtgagga

SEQ ID NO: 5594 - DNA, 9 bp, Artificial Sequence
  Synthetic nucleic acid molecule
gagtgagga

SEQ ID NO: 5595 - DNA, 9 bp, Artificial Sequence
  Synthetic nucleic acid molecule
gagtgagga

SEQ ID NO: 5596 - DNA, 9 bp, Artificial Sequence
  Synthetic nucleic acid molecule
gagtgagga

SEQ ID NO: 5597 - DNA, 9 bp, Artificial Sequence
  Synthetic nucleic acid molecule
gagtgagga

SEQ ID NO: 5598 - DNA, 9 bp, Artificial Sequence
  Synthetic nucleic acid molecule
gagtgagga

SEQ ID NO: 5599 - DNA, 9 bp, Artificial Sequence
  Synthetic nucleic acid molecule
gagtgagga

SEQ ID NO: 5600 - DNA, 9 bp, Artificial Sequence
  Synthetic nucleic acid molecule
gagtgagga

SEQ ID NO: 5601 - DNA, 9 bp, Artificial Sequence
  Synthetic nucleic acid molecule
gagtgagga

SEQ ID NO: 5602 - DNA, 9 bp, Artificial Sequence
  Synthetic nucleic acid molecule
gagtgagga

SEQ ID NO: 5603 - DNA, 9 bp, Artificial Sequence
  Synthetic nucleic acid molecule
gagtgagga

SEQ ID NO: 5604 - DNA, 9 bp, Artificial Sequence
  Synthetic nucleic acid molecule
gagtgagga

SEQ ID NO: 5605 - DNA, 9 bp, Artificial Sequence
  Synthetic nucleic acid molecule
gagtgagga

SEQ ID NO: 5606 - DNA, 9 bp, Artificial Sequence
  Synthetic nucleic acid molecule
gagtgagga

SEQ ID NO: 5607 - DNA, 9 bp, Artificial Sequence
  Synthetic nucleic acid molecule
gagtgagga

SEQ ID NO: 5608 - DNA, 9 bp, Artificial Sequence
  Synthetic nucleic acid molecule
gagtgagga

SEQ ID NO: 5609 - DNA, 9 bp, Artificial Sequence
  Synthetic nucleic acid molecule
gagtgagga

SEQ ID NO: 5610 - DNA, 9 bp, Artificial Sequence
  Synthetic nucleic acid molecule
gagtgagga

SEQ ID NO: 5611 - DNA, 9 bp, Artificial Sequence
  Synthetic nucleic acid molecule
gagtgagga

SEQ ID NO: 5612 - DNA, 9 bp, Artificial Sequence
  Synthetic nucleic acid molecule
gagtgagga

SEQ ID NO: 5613 - DNA, 9 bp, Artificial Sequence
  Synthetic nucleic acid molecule
gagtgagga

SEQ ID NO: 5614 - DNA, 9 bp, Artificial Sequence
  Synthetic nucleic acid molecule
gagtgagga

SEQ ID NO: 5615 - DNA, 9 bp, Artificial Sequence
  Synthetic nucleic acid molecule
gagtgagga

SEQ ID NO: 5616 - DNA, 9 bp, Artificial Sequence
  Synthetic nucleic acid molecule
gagtgagga

SEQ ID NO: 5617 - DNA, 9 bp, Artificial Sequence
  Synthetic nucleic acid molecule
gagtgagga

SEQ ID NO: 5618 - DNA, 9 bp, Artificial Sequence
  Synthetic nucleic acid molecule
gagtgagga

SEQ ID NO: 5619 - DNA, 9 bp, Artificial Sequence
  Synthetic nucleic acid molecule
gagtgagga

SEQ ID NO: 5620 - DNA, 9 bp, Artificial Sequence
  Synthetic nucleic acid molecule
gagtgagga

SEQ ID NO: 5621 - DNA, 9 bp, Artificial Sequence
  Synthetic nucleic acid molecule
gagtgagga

SEQ ID NO: 5622 - DNA, 9 bp, Artificial Sequence
  Synthetic nucleic acid molecule
gagtgagga

SEQ ID NO: 5623 - DNA, 9 bp, Artificial Sequence
  Synthetic nucleic acid molecule
gagtgagga

SEQ ID NO: 5624 - DNA, 9 bp, Artificial Sequence
  Synthetic nucleic acid molecule
gagtgagga

SEQ ID NO: 5625 - DNA, 9 bp, Artificial Sequence
  Synthetic nucleic acid molecule
gagtgagga

SEQ ID NO: 5626 - DNA, 9 bp, Artificial Sequence
  Synthetic nucleic acid molecule
gagtgagga

SEQ ID NO: 5627 - DNA, 9 bp, Artificial Sequence
  Synthetic nucleic acid molecule
gagtgagga

SEQ ID NO: 5628 - DNA, 9 bp, Artificial Sequence
  Synthetic nucleic acid molecule
gagtgagga

SEQ ID NO: 5629 - DNA, 9 bp, Artificial Sequence
  Synthetic nucleic acid molecule
gagtgagga

SEQ ID NO: 5630 - DNA, 9 bp, Artificial Sequence
  Synthetic nucleic acid molecule
gagtgagga

SEQ ID NO: 5631 - DNA, 9 bp, Artificial Sequence
  Synthetic nucleic acid molecule
gagtgagga

SEQ ID NO: 5632 - DNA, 9 bp, Artificial Sequence
  Synthetic nucleic acid molecule
gagtgagga

SEQ ID NO: 5633 - DNA, 9 bp, Artificial Sequence
  Synthetic nucleic acid molecule
gagtgagga

SEQ ID NO: 5634 - DNA, 9 bp, Artificial Sequence
  Synthetic nucleic acid molecule
gagtgagga

SEQ ID NO: 5635 - DNA, 9 bp, Artificial Sequence
  Synthetic nucleic acid molecule
gagtgagga

SEQ ID NO: 5636 - DNA, 9 bp, Artificial Sequence
  Synthetic nucleic acid molecule
gagtgagga

SEQ ID NO: 5637 - DNA, 9 bp, Artificial Sequence
  Synthetic nucleic acid molecule
gagtgagga

SEQ ID NO: 5638 - DNA, 9 bp, Artificial Sequence
  Synthetic nucleic acid molecule
gagtgagga

SEQ ID NO: 5639 - DNA, 9 bp, Artificial Sequence
  Synthetic nucleic acid molecule
gagtgagga

SEQ ID NO: 5640 - DNA, 9 bp, Artificial Sequence
  Synthetic nucleic acid molecule
gagtgagga

SEQ ID NO: 5641 - DNA, 9 bp, Artificial Sequence
  Synthetic nucleic acid molecule
gagtgagga

SEQ ID NO: 5642 - DNA, 9 bp, Artificial Sequence
  Synthetic nucleic acid molecule
cactgatca

SEQ ID NO: 5643 - DNA, 9 bp, Artificial Sequence
  Synthetic nucleic acid molecule
agaggagga

SEQ ID NO: 5644 - DNA, 9 bp, Artificial Sequence
  Synthetic nucleic acid molecule
gagtaggat

SEQ ID NO: 5645 - DNA, 9 bp, Artificial Sequence
  Synthetic nucleic acid molecule
acgtgcgca

SEQ ID NO: 5646 - DNA, 9 bp, Artificial Sequence
  Synthetic nucleic acid molecule
gtgcgagtc

SEQ ID NO: 5647 - DNA, 9 bp, Artificial Sequence
  Synthetic nucleic acid molecule
cagtgttta

SEQ ID NO: 5648 - DNA, 9 bp, Artificial Sequence
  Synthetic nucleic acid molecule
gagtgacac

SEQ ID NO: 5649 - DNA, 9 bp, Artificial Sequence
  Synthetic nucleic acid molecule
gagggtaga

SEQ ID NO: 5650 - DNA, 9 bp, Artificial Sequence
  Synthetic nucleic acid molecule
gagtaagtc

SEQ ID NO: 5651 - DNA, 9 bp, Artificial Sequence
  Synthetic nucleic acid molecule
gtgagagaa

SEQ ID NO: 5652 - DNA, 9 bp, Artificial Sequence
  Synthetic nucleic acid molecule
gtgagagaa

SEQ ID NO: 5653 - DNA, 9 bp, Artificial Sequence
  Synthetic nucleic acid molecule
gagtgatag

SEQ ID NO: 5654 - DNA, 9 bp, Artificial Sequence
  Synthetic nucleic acid molecule
gggtgatgc

SEQ ID NO: 5655 - DNA, 9 bp, Artificial Sequence
  Synthetic nucleic acid molecule
cagtgagcc

SEQ ID NO: 5656 - DNA, 9 bp, Artificial Sequence
  Synthetic nucleic acid molecule
gagtaagtg

SEQ ID NO: 5657 - DNA, 9 bp, Artificial Sequence
  Synthetic nucleic acid molecule
gagtatggg

SEQ ID NO: 5658 - DNA, 9 bp, Artificial Sequence
  Synthetic nucleic acid molecule
gtgtcaggc

SEQ ID NO: 5659 - DNA, 9 bp, Artificial Sequence
  Synthetic nucleic acid molecule
tggtgaggt

SEQ ID NO: 5660 - DNA, 9 bp, Artificial Sequence
  Synthetic nucleic acid molecule
gtgagggga

SEQ ID NO: 5661 - DNA, 9 bp, Artificial Sequence
  Synthetic nucleic acid molecule
cagtgagac

SEQ ID NO: 5662 - DNA, 9 bp, Artificial Sequence
  Synthetic nucleic acid molecule
gtaagagga

SEQ ID NO: 5663 - DNA, 9 bp, Artificial Sequence
  Synthetic nucleic acid molecule
gcgtgggaa

SEQ ID NO: 5664 - DNA, 9 bp, Artificial Sequence
  Synthetic nucleic acid molecule
gtgtgaggc

SEQ ID NO: 5665 - DNA, 9 bp, Artificial Sequence
  Synthetic nucleic acid molecule
aagtgaggg

SEQ ID NO: 5666 - DNA, 9 bp, Artificial Sequence
  Synthetic nucleic acid molecule
aagtgaggc

SEQ ID NO: 5667 - DNA, 9 bp, Artificial Sequence
  Synthetic nucleic acid molecule
gagtgagac

SEQ ID NO: 5668 - DNA, 9 bp, Artificial Sequence
  Synthetic nucleic acid molecule
aagtgaggg

SEQ ID NO: 5669 - DNA, 9 bp, Artificial Sequence
  Synthetic nucleic acid molecule
gagtgagat

SEQ ID NO: 5670 - DNA, 9 bp, Artificial Sequence
  Synthetic nucleic acid molecule
gagagtgga

SEQ ID NO: 5671 - DNA, 9 bp, Artificial Sequence
  Synthetic nucleic acid molecule
gagtaaggg

SEQ ID NO: 5672 - DNA, 9 bp, Artificial Sequence
  Synthetic nucleic acid molecule
gagtaacga

SEQ ID NO: 5673 - DNA, 9 bp, Artificial Sequence
  Synthetic nucleic acid molecule
cagtgaggg

SEQ ID NO: 5674 - DNA, 9 bp, Artificial Sequence
  Synthetic nucleic acid molecule
gtgtgaggt

SEQ ID NO: 5675 - DNA, 9 bp, Artificial Sequence
  Synthetic nucleic acid molecule
gagtaaggg

SEQ ID NO: 5676 - DNA, 9 bp, Artificial Sequence
  Synthetic nucleic acid molecule
gagtaaggg

SEQ ID NO: 5677 - DNA, 9 bp, Artificial Sequence
  Synthetic nucleic acid molecule
gagggaggc

SEQ ID NO: 5678 - DNA, 9 bp, Artificial Sequence
  Synthetic nucleic acid molecule
aagtgaggg

SEQ ID NO: 5679 - DNA, 9 bp, Artificial Sequence
  Synthetic nucleic acid molecule
gagtaaggt

SEQ ID NO: 5680 - DNA, 9 bp, Artificial Sequence
  Synthetic nucleic acid molecule
aagtgaggg

SEQ ID NO: 5681 - DNA, 9 bp, Artificial Sequence
  Synthetic nucleic acid molecule
cagtgaggg

SEQ ID NO: 5682 - DNA, 9 bp, Artificial Sequence
  Synthetic nucleic acid molecule
gagagaggt

SEQ ID NO: 5683 - DNA, 9 bp, Artificial Sequence
  Synthetic nucleic acid molecule
gtgtgaggc

SEQ ID NO: 5684 - DNA, 9 bp, Artificial Sequence
  Synthetic nucleic acid molecule
gagggaggc

SEQ ID NO: 5685 - DNA, 9 bp, Artificial Sequence
  Synthetic nucleic acid molecule
aagtgaggg

SEQ ID NO: 5686 - DNA, 9 bp, Artificial Sequence
  Synthetic nucleic acid molecule
gagggaggt

SEQ ID NO: 5687 - DNA, 9 bp, Artificial Sequence
  Synthetic nucleic acid molecule
gagtgagtc

SEQ ID NO: 5688 - DNA, 9 bp, Artificial Sequence
  Synthetic nucleic acid molecule
tagtgaggc

SEQ ID NO: 5689 - DNA, 9 bp, Artificial Sequence
  Synthetic nucleic acid molecule
aagtgaggg

SEQ ID NO: 5690 - DNA, 9 bp, Artificial Sequence
  Synthetic nucleic acid molecule
gagtaaggg

SEQ ID NO: 5691 - DNA, 9 bp, Artificial Sequence
  Synthetic nucleic acid molecule
aagtgaggc

SEQ ID NO: 5692 - DNA, 9 bp, Artificial Sequence
  Synthetic nucleic acid molecule
gtgtgaggc

SEQ ID NO: 5693 - DNA, 9 bp, Artificial Sequence
  Synthetic nucleic acid molecule
gagtgagtc

SEQ ID NO: 5694 - DNA, 9 bp, Artificial Sequence
  Synthetic nucleic acid molecule
gagtgaggg

SEQ ID NO: 5695 - DNA, 9 bp, Artificial Sequence
  Synthetic nucleic acid molecule
gagtgaggt

SEQ ID NO: 5696 - DNA, 9 bp, Artificial Sequence
  Synthetic nucleic acid molecule
gagtgaggg

SEQ ID NO: 5697 - DNA, 9 bp, Artificial Sequence
  Synthetic nucleic acid molecule
gagtgaggg

SEQ ID NO: 5698 - DNA, 9 bp, Artificial Sequence
  Synthetic nucleic acid molecule
gagtgaggg

SEQ ID NO: 5699 - DNA, 9 bp, Artificial Sequence
  Synthetic nucleic acid molecule
gagtgaggg

SEQ ID NO: 5700 - DNA, 9 bp, Artificial Sequence
  Synthetic nucleic acid molecule
gagtgaggc

SEQ ID NO: 5701 - DNA, 9 bp, Artificial Sequence
  Synthetic nucleic acid molecule
aagtgagga

SEQ ID NO: 5702 - DNA, 9 bp, Artificial Sequence
  Synthetic nucleic acid molecule
gagtgaggg

SEQ ID NO: 5703 - DNA, 9 bp, Artificial Sequence
  Synthetic nucleic acid molecule
gtgtgagga

SEQ ID NO: 5704 - DNA, 9 bp, Artificial Sequence
  Synthetic nucleic acid molecule
gagtgaggg

SEQ ID NO: 5705 - DNA, 9 bp, Artificial Sequence
  Synthetic nucleic acid molecule
aagtgagga

SEQ ID NO: 5706 - DNA, 9 bp, Artificial Sequence
  Synthetic nucleic acid molecule
gagtgaggc

SEQ ID NO: 5707 - DNA, 9 bp, Artificial Sequence
  Synthetic nucleic acid molecule
gagtgaggt

SEQ ID NO: 5708 - DNA, 9 bp, Artificial Sequence
  Synthetic nucleic acid molecule
gagtgaggg

SEQ ID NO: 5709 - DNA, 9 bp, Artificial Sequence
  Synthetic nucleic acid molecule
gagtgaggt

SEQ ID NO: 5710 - DNA, 9 bp, Artificial Sequence
  Synthetic nucleic acid molecule
gagtgaggg

SEQ ID NO: 5711 - DNA, 9 bp, Artificial Sequence
  Synthetic nucleic acid molecule
gagtgaggg

SEQ ID NO: 5712 - DNA, 9 bp, Artificial Sequence
  Synthetic nucleic acid molecule
gagtgaggt

SEQ ID NO: 5713 - DNA, 9 bp, Artificial Sequence
  Synthetic nucleic acid molecule
gagtgaggc

SEQ ID NO: 5714 - DNA, 9 bp, Artificial Sequence
  Synthetic nucleic acid molecule
gagtgaggt

SEQ ID NO: 5715 - DNA, 9 bp, Artificial Sequence
  Synthetic nucleic acid molecule
gagtgaggt

SEQ ID NO: 5716 - DNA, 9 bp, Artificial Sequence
  Synthetic nucleic acid molecule
gagtgaggg

SEQ ID NO: 5717 - DNA, 9 bp, Artificial Sequence
  Synthetic nucleic acid molecule
gagtgaggc

SEQ ID NO: 5718 - DNA, 9 bp, Artificial Sequence
  Synthetic nucleic acid molecule
gagtgaggg

SEQ ID NO: 5719 - DNA, 9 bp, Artificial Sequence
  Synthetic nucleic acid molecule
gagtgaggg

SEQ ID NO: 5720 - DNA, 9 bp, Artificial Sequence
  Synthetic nucleic acid molecule
gagtgaggg

SEQ ID NO: 5721 - DNA, 9 bp, Artificial Sequence
  Synthetic nucleic acid molecule
gagtgaggg

SEQ ID NO: 5722 - DNA, 9 bp, Artificial Sequence
  Synthetic nucleic acid molecule
gagtgaggg

SEQ ID NO: 5723 - DNA, 9 bp, Artificial Sequence
  Synthetic nucleic acid molecule
gagtgaggg

SEQ ID NO: 5724 - DNA, 9 bp, Artificial Sequence
  Synthetic nucleic acid molecule
gagtgaggg

SEQ ID NO: 5725 - DNA, 9 bp, Artificial Sequence
  Synthetic nucleic acid molecule
gagtgaggt

SEQ ID NO: 5726 - DNA, 9 bp, Artificial Sequence
  Synthetic nucleic acid molecule
gagtgaggc

SEQ ID NO: 5727 - DNA, 9 bp, Artificial Sequence
  Synthetic nucleic acid molecule
gagtgaggg

SEQ ID NO: 5728 - DNA, 9 bp, Artificial Sequence
  Synthetic nucleic acid molecule
gagtgaggt

SEQ ID NO: 5729 - DNA, 9 bp, Artificial Sequence
  Synthetic nucleic acid molecule
aagtgaggc

SEQ ID NO: 5730 - DNA, 9 bp, Artificial Sequence
  Synthetic nucleic acid molecule
aagtgaggg

SEQ ID NO: 5731 - DNA, 9 bp, Artificial Sequence
  Synthetic nucleic acid molecule
aagtgaggg

SEQ ID NO: 5732 - DNA, 9 bp, Artificial Sequence
  Synthetic nucleic acid molecule
cagtgagga

SEQ ID NO: 5733 - DNA, 9 bp, Artificial Sequence
  Synthetic nucleic acid molecule
cagtgaggc

SEQ ID NO: 5734 - DNA, 9 bp, Artificial Sequence
  Synthetic nucleic acid molecule
gagtgaggg

SEQ ID NO: 5735 - DNA, 9 bp, Artificial Sequence
  Synthetic nucleic acid molecule
gagtgaggg

SEQ ID NO: 5736 - DNA, 9 bp, Artificial Sequence
  Synthetic nucleic acid molecule
gagtgaggc

SEQ ID NO: 5737 - DNA, 9 bp, Artificial Sequence
  Synthetic nucleic acid molecule
gagtgaggc

SEQ ID NO: 5738 - DNA, 9 bp, Artificial Sequence
  Synthetic nucleic acid molecule
gagtgaggc

SEQ ID NO: 5739 - DNA, 9 bp, Artificial Sequence
  Synthetic nucleic acid molecule
gaatgagga

SEQ ID NO: 5740 - DNA, 9 bp, Artificial Sequence
  Synthetic nucleic acid molecule
gattgagga

SEQ ID NO: 5741 - DNA, 9 bp, Artificial Sequence
  Synthetic nucleic acid molecule
tagagatga

SEQ ID NO: 5742 - DNA, 9 bp, Artificial Sequence
  Synthetic nucleic acid molecule
aagtatgga

SEQ ID NO: 5743 - DNA, 9 bp, Artificial Sequence
  Synthetic nucleic acid molecule
tagtaatga

SEQ ID NO: 5744 - DNA, 9 bp, Artificial Sequence
  Synthetic nucleic acid molecule
tagtaatga

SEQ ID NO: 5745 - DNA, 9 bp, Artificial Sequence
  Synthetic nucleic acid molecule
aagagagga

SEQ ID NO: 5746 - DNA, 9 bp, Artificial Sequence
  Synthetic nucleic acid molecule
gagagagaa

SEQ ID NO: 5747 - DNA, 9 bp, Artificial Sequence
  Synthetic nucleic acid molecule
aagagagga

SEQ ID NO: 5748 - DNA, 9 bp, Artificial Sequence
  Synthetic nucleic acid molecule
gagtgaaaa

SEQ ID NO: 5749 - DNA, 9 bp, Artificial Sequence
  Synthetic nucleic acid molecule
gagagggga

SEQ ID NO: 5750 - DNA, 9 bp, Artificial Sequence
  Synthetic nucleic acid molecule
gagtgtggg

SEQ ID NO: 5751 - DNA, 9 bp, Artificial Sequence
  Synthetic nucleic acid molecule
gaaggagga

SEQ ID NO: 5752 - DNA, 9 bp, Artificial Sequence
  Synthetic nucleic acid molecule
gagagagaa

SEQ ID NO: 5753 - DNA, 9 bp, Artificial Sequence
  Synthetic nucleic acid molecule
gagtggggt

SEQ ID NO: 5754 - DNA, 9 bp, Artificial Sequence
  Synthetic nucleic acid molecule
gagagagaa

SEQ ID NO: 5755 - DNA, 9 bp, Artificial Sequence
  Synthetic nucleic acid molecule
gagtgagtt

SEQ ID NO: 5756 - DNA, 9 bp, Artificial Sequence
  Synthetic nucleic acid molecule
gggtgaggc

SEQ ID NO: 5757 - DNA, 9 bp, Artificial Sequence
  Synthetic nucleic acid molecule
gagggacga

SEQ ID NO: 5758 - DNA, 9 bp, Artificial Sequence
  Synthetic nucleic acid molecule
gggtgagca

SEQ ID NO: 5759 - DNA, 9 bp, Artificial Sequence
  Synthetic nucleic acid molecule
gagggagta

SEQ ID NO: 5760 - DNA, 9 bp, Artificial Sequence
  Synthetic nucleic acid molecule
aagtgaaga

SEQ ID NO: 5761 - DNA, 9 bp, Artificial Sequence
  Synthetic nucleic acid molecule
gggtgaggc

SEQ ID NO: 5762 - DNA, 9 bp, Artificial Sequence
  Synthetic nucleic acid molecule
gggtgagaa

SEQ ID NO: 5763 - DNA, 9 bp, Artificial Sequence
  Synthetic nucleic acid molecule
gagtaagaa

SEQ ID NO: 5764 - DNA, 9 bp, Artificial Sequence
  Synthetic nucleic acid molecule
gagcgaggg

SEQ ID NO: 5765 - DNA, 9 bp, Artificial Sequence
  Synthetic nucleic acid molecule
gactgagca

SEQ ID NO: 5766 - DNA, 9 bp, Artificial Sequence
  Synthetic nucleic acid molecule
gaatgaggc

SEQ ID NO: 5767 - DNA, 9 bp, Artificial Sequence
  Synthetic nucleic acid molecule
aagagagga

SEQ ID NO: 5768 - DNA, 9 bp, Artificial Sequence
  Synthetic nucleic acid molecule
gagtcaggg

SEQ ID NO: 5769 - DNA, 9 bp, Artificial Sequence
  Synthetic nucleic acid molecule
gagggagaa

SEQ ID NO: 5770 - DNA, 9 bp, Artificial Sequence
  Synthetic nucleic acid molecule
gactgaggg

SEQ ID NO: 5771 - DNA, 9 bp, Artificial Sequence
  Synthetic nucleic acid molecule
gaaggagga

SEQ ID NO: 5772 - DNA, 9 bp, Artificial Sequence
  Synthetic nucleic acid molecule
taatgagga

SEQ ID NO: 5773 - DNA, 9 bp, Artificial Sequence
  Synthetic nucleic acid molecule
gagagagaa

SEQ ID NO: 5774 - DNA, 9 bp, Artificial Sequence
  Synthetic nucleic acid molecule
gaatgaggc

SEQ ID NO: 5775 - DNA, 9 bp, Artificial Sequence
  Synthetic nucleic acid molecule
aggtgagga

SEQ ID NO: 5776 - DNA, 9 bp, Artificial Sequence
  Synthetic nucleic acid molecule
aagtgggga

SEQ ID NO: 5777 - DNA, 9 bp, Artificial Sequence
  Synthetic nucleic acid molecule
gagtgggga

SEQ ID NO: 5778 - DNA, 9 bp, Artificial Sequence
  Synthetic nucleic acid molecule
gtgtgagga

SEQ ID NO: 5779 - DNA, 9 bp, Artificial Sequence
  Synthetic nucleic acid molecule
gagttagga

SEQ ID NO: 5780 - DNA, 9 bp, Artificial Sequence
  Synthetic nucleic acid molecule
tagtgagga

SEQ ID NO: 5781 - DNA, 9 bp, Artificial Sequence
  Synthetic nucleic acid molecule
aagtgagga

SEQ ID NO: 5782 - DNA, 9 bp, Artificial Sequence
  Synthetic nucleic acid molecule
gagtgagta

SEQ ID NO: 5783 - DNA, 9 bp, Artificial Sequence
  Synthetic nucleic acid molecule
gagtgagca

SEQ ID NO: 5784 - DNA, 9 bp, Artificial Sequence
  Synthetic nucleic acid molecule
gagtcagga

SEQ ID NO: 5785 - DNA, 9 bp, Artificial Sequence
  Synthetic nucleic acid molecule
gagtgagta

SEQ ID NO: 5786 - DNA, 9 bp, Artificial Sequence
  Synthetic nucleic acid molecule
gagtgagaa

SEQ ID NO: 5787 - DNA, 9 bp, Artificial Sequence
  Synthetic nucleic acid molecule
gagcgagga

SEQ ID NO: 5788 - DNA, 9 bp, Artificial Sequence
  Synthetic nucleic acid molecule
aagtgagga

SEQ ID NO: 5789 - DNA, 9 bp, Artificial Sequence
  Synthetic nucleic acid molecule
gagttagga

SEQ ID NO: 5790 - DNA, 9 bp, Artificial Sequence
  Synthetic nucleic acid molecule
aagtgagga

SEQ ID NO: 5791 - DNA, 9 bp, Artificial Sequence
  Synthetic nucleic acid molecule
gtgtgagga

SEQ ID NO: 5792 - DNA, 9 bp, Artificial Sequence
  Synthetic nucleic acid molecule
gagagagga

SEQ ID NO: 5793 - DNA, 9 bp, Artificial Sequence
  Synthetic nucleic acid molecule
aagtgagga

SEQ ID NO: 5794 - DNA, 9 bp, Artificial Sequence
  Synthetic nucleic acid molecule
gagtgagca

SEQ ID NO: 5795 - DNA, 9 bp, Artificial Sequence
  Synthetic nucleic acid molecule
gagagagga

SEQ ID NO: 5796 - DNA, 9 bp, Artificial Sequence
  Synthetic nucleic acid molecule
gagggagga

SEQ ID NO: 5797 - DNA, 9 bp, Artificial Sequence
  Synthetic nucleic acid molecule
gagtgagta

SEQ ID NO: 5798 - DNA, 9 bp, Artificial Sequence
  Synthetic nucleic acid molecule
gaatgagga

SEQ ID NO: 5799 - DNA, 9 bp, Artificial Sequence
  Synthetic nucleic acid molecule
aagtgagga

SEQ ID NO: 5800 - DNA, 9 bp, Artificial Sequence
  Synthetic nucleic acid molecule
aagtgagga

SEQ ID NO: 5801 - DNA, 9 bp, Artificial Sequence
  Synthetic nucleic acid molecule
gagtgaggc

SEQ ID NO: 5802 - DNA, 9 bp, Artificial Sequence
  Synthetic nucleic acid molecule
gagtgagta

SEQ ID NO: 5803 - DNA, 9 bp, Artificial Sequence
  Synthetic nucleic acid molecule
gagtgagca

SEQ ID NO: 5804 - DNA, 9 bp, Artificial Sequence
  Synthetic nucleic acid molecule
gagggagga

SEQ ID NO: 5805 - DNA, 9 bp, Artificial Sequence
  Synthetic nucleic acid molecule
gagtgatga

SEQ ID NO: 5806 - DNA, 9 bp, Artificial Sequence
  Synthetic nucleic acid molecule
gagtcagga

SEQ ID NO: 5807 - DNA, 9 bp, Artificial Sequence
  Synthetic nucleic acid molecule
gagtgagaa

SEQ ID NO: 5808 - DNA, 9 bp, Artificial Sequence
  Synthetic nucleic acid molecule
gagtgagca

SEQ ID NO: 5809 - DNA, 9 bp, Artificial Sequence
  Synthetic nucleic acid molecule
cagtgagga

SEQ ID NO: 5810 - DNA, 9 bp, Artificial Sequence
  Synthetic nucleic acid molecule
gagcgagga

SEQ ID NO: 5811 - DNA, 9 bp, Artificial Sequence
  Synthetic nucleic acid molecule
gtgtgagga

SEQ ID NO: 5812 - DNA, 9 bp, Artificial Sequence
  Synthetic nucleic acid molecule
gagtgaaga

SEQ ID NO: 5813 - DNA, 9 bp, Artificial Sequence
  Synthetic nucleic acid molecule
gagtgagca

SEQ ID NO: 5814 - DNA, 9 bp, Artificial Sequence
  Synthetic nucleic acid molecule
gagtgtgga

SEQ ID NO: 5815 - DNA, 9 bp, Artificial Sequence
  Synthetic nucleic acid molecule
tagtgagga

SEQ ID NO: 5816 - DNA, 9 bp, Artificial Sequence
  Synthetic nucleic acid molecule
gagtgagga

SEQ ID NO: 5817 - DNA, 9 bp, Artificial Sequence
  Synthetic nucleic acid molecule
gagtgagga

SEQ ID NO: 5818 - DNA, 9 bp, Artificial Sequence
  Synthetic nucleic acid molecule
gagtgagga

SEQ ID NO: 5819 - DNA, 9 bp, Artificial Sequence
  Synthetic nucleic acid molecule
gagtgagga

SEQ ID NO: 5820 - DNA, 9 bp, Artificial Sequence
  Synthetic nucleic acid molecule
gagtgagga

SEQ ID NO: 5821 - DNA, 9 bp, Artificial Sequence
  Synthetic nucleic acid molecule
gagtgagga

SEQ ID NO: 5822 - DNA, 9 bp, Artificial Sequence
  Synthetic nucleic acid molecule
gagtgagga

SEQ ID NO: 5823 - DNA, 9 bp, Artificial Sequence
  Synthetic nucleic acid molecule
gagtgagga

SEQ ID NO: 5824 - DNA, 9 bp, Artificial Sequence
  Synthetic nucleic acid molecule
gagtgagga

SEQ ID NO: 5825 - DNA, 9 bp, Artificial Sequence
  Synthetic nucleic acid molecule
gagtgagga

SEQ ID NO: 5826 - DNA, 9 bp, Artificial Sequence
  Synthetic nucleic acid molecule
gagtgagga

SEQ ID NO: 5827 - DNA, 9 bp, Artificial Sequence
  Synthetic nucleic acid molecule
gagtgagga

SEQ ID NO: 5828 - DNA, 9 bp, Artificial Sequence
  Synthetic nucleic acid molecule
gagtgagga

SEQ ID NO: 5829 - DNA, 9 bp, Artificial Sequence
  Synthetic nucleic acid molecule
gagtgagga

SEQ ID NO: 5830 - DNA, 9 bp, Artificial Sequence
  Synthetic nucleic acid molecule
gagtgagga

SEQ ID NO: 5831 - DNA, 9 bp, Artificial Sequence
  Synthetic nucleic acid molecule
gagtgagga

SEQ ID NO: 5832 - DNA, 9 bp, Artificial Sequence
  Synthetic nucleic acid molecule
aagtggagg

SEQ ID NO: 5833 - DNA, 9 bp, Artificial Sequence
  Synthetic nucleic acid molecule
agtggagga

SEQ ID NO: 5834 - DNA, 9 bp, Artificial Sequence
  Synthetic nucleic acid molecule
gagttaacc

SEQ ID NO: 5835 - DNA, 9 bp, Artificial Sequence
  Synthetic nucleic acid molecule
aattgtgca

SEQ ID NO: 5836 - DNA, 9 bp, Artificial Sequence
  Synthetic nucleic acid molecule
gagggacca

SEQ ID NO: 5837 - DNA, 9 bp, Artificial Sequence
  Synthetic nucleic acid molecule
gagggagtc

SEQ ID NO: 5838 - DNA, 9 bp, Artificial Sequence
  Synthetic nucleic acid molecule
gtgtgtggc

SEQ ID NO: 5839 - DNA, 9 bp, Artificial Sequence
  Synthetic nucleic acid molecule
aactgaggt

SEQ ID NO: 5840 - DNA, 9 bp, Artificial Sequence
  Synthetic nucleic acid molecule
gactgaagc

SEQ ID NO: 5841 - DNA, 9 bp, Artificial Sequence
  Synthetic nucleic acid molecule
gagtgacat

SEQ ID NO: 5842 - DNA, 9 bp, Artificial Sequence
  Synthetic nucleic acid molecule
gagtgtgtc

SEQ ID NO: 5843 - DNA, 9 bp, Artificial Sequence
  Synthetic nucleic acid molecule
gaggcaaga

SEQ ID NO: 5844 - DNA, 9 bp, Artificial Sequence
  Synthetic nucleic acid molecule
gcgagaggc

SEQ ID NO: 5845 - DNA, 9 bp, Artificial Sequence
  Synthetic nucleic acid molecule
aagtgagac

SEQ ID NO: 5846 - DNA, 9 bp, Artificial Sequence
  Synthetic nucleic acid molecule
gagagggca

SEQ ID NO: 5847 - DNA, 9 bp, Artificial Sequence
  Synthetic nucleic acid molecule
gtgtgtgta

SEQ ID NO: 5848 - DNA, 9 bp, Artificial Sequence
  Synthetic nucleic acid molecule
gagtgaaag

SEQ ID NO: 5849 - DNA, 9 bp, Artificial Sequence
  Synthetic nucleic acid molecule
gagggagtc

SEQ ID NO: 5850 - DNA, 9 bp, Artificial Sequence
  Synthetic nucleic acid molecule
gagtgcgac

SEQ ID NO: 5851 - DNA, 9 bp, Artificial Sequence
  Synthetic nucleic acid molecule
aagtgcggg

SEQ ID NO: 5852 - DNA, 9 bp, Artificial Sequence
  Synthetic nucleic acid molecule
tggtgtgga

SEQ ID NO: 5853 - DNA, 9 bp, Artificial Sequence
  Synthetic nucleic acid molecule
gtgtgataa

SEQ ID NO: 5854 - DNA, 9 bp, Artificial Sequence
  Synthetic nucleic acid molecule
gagtgattt

SEQ ID NO: 5855 - DNA, 9 bp, Artificial Sequence
  Synthetic nucleic acid molecule
gtgtgcggc

SEQ ID NO: 5856 - DNA, 9 bp, Artificial Sequence
  Synthetic nucleic acid molecule
gagggtggt

SEQ ID NO: 5857 - DNA, 9 bp, Artificial Sequence
  Synthetic nucleic acid molecule
gagtgggac

SEQ ID NO: 5858 - DNA, 9 bp, Artificial Sequence
  Synthetic nucleic acid molecule
gagacaggc

SEQ ID NO: 5859 - DNA, 9 bp, Artificial Sequence
  Synthetic nucleic acid molecule
gtgtggggg

SEQ ID NO: 5860 - DNA, 9 bp, Artificial Sequence
  Synthetic nucleic acid molecule
gactgagag

SEQ ID NO: 5861 - DNA, 9 bp, Artificial Sequence
  Synthetic nucleic acid molecule
cagtaaggt

SEQ ID NO: 5862 - DNA, 9 bp, Artificial Sequence
  Synthetic nucleic acid molecule
aagcaagga

SEQ ID NO: 5863 - DNA, 9 bp, Artificial Sequence
  Synthetic nucleic acid molecule
gggagaggt

SEQ ID NO: 5864 - DNA, 9 bp, Artificial Sequence
  Synthetic nucleic acid molecule
tggtgtgga

SEQ ID NO: 5865 - DNA, 9 bp, Artificial Sequence
  Synthetic nucleic acid molecule
aagtgagat

SEQ ID NO: 5866 - DNA, 9 bp, Artificial Sequence
  Synthetic nucleic acid molecule
gagtgtgtc

SEQ ID NO: 5867 - DNA, 9 bp, Artificial Sequence
  Synthetic nucleic acid molecule
tagtgagct

SEQ ID NO: 5868 - DNA, 9 bp, Artificial Sequence
  Synthetic nucleic acid molecule
acgagagga

SEQ ID NO: 5869 - DNA, 9 bp, Artificial Sequence
  Synthetic nucleic acid molecule
gagggtggt

SEQ ID NO: 5870 - DNA, 9 bp, Artificial Sequence
  Synthetic nucleic acid molecule
gaggcaaga

SEQ ID NO: 5871 - DNA, 9 bp, Artificial Sequence
  Synthetic nucleic acid molecule
tggtgagga

SEQ ID NO: 5872 - DNA, 9 bp, Artificial Sequence
  Synthetic nucleic acid molecule
gggtgaggt

SEQ ID NO: 5873 - DNA, 9 bp, Artificial Sequence
  Synthetic nucleic acid molecule
gagagaggg

SEQ ID NO: 5874 - DNA, 9 bp, Artificial Sequence
  Synthetic nucleic acid molecule
gagtgtggg

SEQ ID NO: 5875 - DNA, 9 bp, Artificial Sequence
  Synthetic nucleic acid molecule
gagggaggc

SEQ ID NO: 5876 - DNA, 9 bp, Artificial Sequence
  Synthetic nucleic acid molecule
aagtgaggt

SEQ ID NO: 5877 - DNA, 9 bp, Artificial Sequence
  Synthetic nucleic acid molecule
gagtgagct

SEQ ID NO: 5878 - DNA, 9 bp, Artificial Sequence
  Synthetic nucleic acid molecule
cagtgagaa

SEQ ID NO: 5879 - DNA, 9 bp, Artificial Sequence
  Synthetic nucleic acid molecule
gagtgtggc

SEQ ID NO: 5880 - DNA, 9 bp, Artificial Sequence
  Synthetic nucleic acid molecule
gagcgaggg

SEQ ID NO: 5881 - DNA, 9 bp, Artificial Sequence
  Synthetic nucleic acid molecule
gagaaagga

SEQ ID NO: 5882 - DNA, 9 bp, Artificial Sequence
  Synthetic nucleic acid molecule
gagtgagag

SEQ ID NO: 5883 - DNA, 9 bp, Artificial Sequence
  Synthetic nucleic acid molecule
gagcaagga

SEQ ID NO: 5884 - DNA, 9 bp, Artificial Sequence
  Synthetic nucleic acid molecule
gagggaggg

SEQ ID NO: 5885 - DNA, 9 bp, Artificial Sequence
  Synthetic nucleic acid molecule
gcgtgaggc

SEQ ID NO: 5886 - DNA, 9 bp, Artificial Sequence
  Synthetic nucleic acid molecule
gagggaggt

SEQ ID NO: 5887 - DNA, 9 bp, Artificial Sequence
  Synthetic nucleic acid molecule
gagtgagtc

SEQ ID NO: 5888 - DNA, 9 bp, Artificial Sequence
  Synthetic nucleic acid molecule
tagtgaggc

SEQ ID NO: 5889 - DNA, 9 bp, Artificial Sequence
  Synthetic nucleic acid molecule
gagtgagcg

SEQ ID NO: 5890 - DNA, 9 bp, Artificial Sequence
  Synthetic nucleic acid molecule
aagtgaggc

SEQ ID NO: 5891 - DNA, 9 bp, Artificial Sequence
  Synthetic nucleic acid molecule
aagtgaggc

SEQ ID NO: 5892 - DNA, 9 bp, Artificial Sequence
  Synthetic nucleic acid molecule
gagggaggg

SEQ ID NO: 5893 - DNA, 9 bp, Artificial Sequence
  Synthetic nucleic acid molecule
gagagaggg

SEQ ID NO: 5894 - DNA, 9 bp, Artificial Sequence
  Synthetic nucleic acid molecule
gagtgtggg

SEQ ID NO: 5895 - DNA, 9 bp, Artificial Sequence
  Synthetic nucleic acid molecule
tagtgagta

SEQ ID NO: 5896 - DNA, 9 bp, Artificial Sequence
  Synthetic nucleic acid molecule
gagtgagat

SEQ ID NO: 5897 - DNA, 9 bp, Artificial Sequence
  Synthetic nucleic acid molecule
gagagaggc

SEQ ID NO: 5898 - DNA, 9 bp, Artificial Sequence
  Synthetic nucleic acid molecule
gagagaggg

SEQ ID NO: 5899 - DNA, 9 bp, Artificial Sequence
  Synthetic nucleic acid molecule
gagggaggg

SEQ ID NO: 5900 - DNA, 9 bp, Artificial Sequence
  Synthetic nucleic acid molecule
cagtgaggc

SEQ ID NO: 5901 - DNA, 9 bp, Artificial Sequence
  Synthetic nucleic acid molecule
cagtgaggt

SEQ ID NO: 5902 - DNA, 9 bp, Artificial Sequence
  Synthetic nucleic acid molecule
aagtgagaa

SEQ ID NO: 5903 - DNA, 9 bp, Artificial Sequence
  Synthetic nucleic acid molecule
gagtgaaaa

SEQ ID NO: 5904 - DNA, 9 bp, Artificial Sequence
  Synthetic nucleic acid molecule
aagtgaggt

SEQ ID NO: 5905 - DNA, 9 bp, Artificial Sequence
  Synthetic nucleic acid molecule
gtgtgaggt

SEQ ID NO: 5906 - DNA, 9 bp, Artificial Sequence
  Synthetic nucleic acid molecule
gagtgagcc

SEQ ID NO: 5907 - DNA, 9 bp, Artificial Sequence
  Synthetic nucleic acid molecule
gagtaaggg

SEQ ID NO: 5908 - DNA, 9 bp, Artificial Sequence
  Synthetic nucleic acid molecule
gagggaggc

SEQ ID NO: 5909 - DNA, 9 bp, Artificial Sequence
  Synthetic nucleic acid molecule
tagtgaggc

SEQ ID NO: 5910 - DNA, 9 bp, Artificial Sequence
  Synthetic nucleic acid molecule
gagtgaata

SEQ ID NO: 5911 - DNA, 9 bp, Artificial Sequence
  Synthetic nucleic acid molecule
gagtaaggc

SEQ ID NO: 5912 - DNA, 9 bp, Artificial Sequence
  Synthetic nucleic acid molecule
cagtgaggc

SEQ ID NO: 5913 - DNA, 9 bp, Artificial Sequence
  Synthetic nucleic acid molecule
gagtgagag

SEQ ID NO: 5914 - DNA, 9 bp, Artificial Sequence
  Synthetic nucleic acid molecule
gagtgagat

SEQ ID NO: 5915 - DNA, 9 bp, Artificial Sequence
  Synthetic nucleic acid molecule
gagtgagct

SEQ ID NO: 5916 - DNA, 9 bp, Artificial Sequence
  Synthetic nucleic acid molecule
gtgtgaggt

SEQ ID NO: 5917 - DNA, 9 bp, Artificial Sequence
  Synthetic nucleic acid molecule
gggtgaggc

SEQ ID NO: 5918 - DNA, 9 bp, Artificial Sequence
  Synthetic nucleic acid molecule
gtgtgaggt

SEQ ID NO: 5919 - DNA, 9 bp, Artificial Sequence
  Synthetic nucleic acid molecule
tagtgaggt

SEQ ID NO: 5920 - DNA, 9 bp, Artificial Sequence
  Synthetic nucleic acid molecule
gagagaggt

SEQ ID NO: 5921 - DNA, 9 bp, Artificial Sequence
  Synthetic nucleic acid molecule
gggtgaggc

SEQ ID NO: 5922 - DNA, 9 bp, Artificial Sequence
  Synthetic nucleic acid molecule
gagtgagat

SEQ ID NO: 5923 - DNA, 9 bp, Artificial Sequence
  Synthetic nucleic acid molecule
gagtgagag

SEQ ID NO: 5924 - DNA, 9 bp, Artificial Sequence
  Synthetic nucleic acid molecule
gagagaggg

SEQ ID NO: 5925 - DNA, 9 bp, Artificial Sequence
  Synthetic nucleic acid molecule
gagtgaggc

SEQ ID NO: 5926 - DNA, 9 bp, Artificial Sequence
  Synthetic nucleic acid molecule
gagtgaggg

SEQ ID NO: 5927 - DNA, 9 bp, Artificial Sequence
  Synthetic nucleic acid molecule
gagtgaggc

SEQ ID NO: 5928 - DNA, 9 bp, Artificial Sequence
  Synthetic nucleic acid molecule
gagtgaggg

SEQ ID NO: 5929 - DNA, 9 bp, Artificial Sequence
  Synthetic nucleic acid molecule
gagtgaggc

SEQ ID NO: 5930 - DNA, 9 bp, Artificial Sequence
  Synthetic nucleic acid molecule
gagtgaggt

SEQ ID NO: 5931 - DNA, 9 bp, Artificial Sequence
  Synthetic nucleic acid molecule
gagtgaggt

SEQ ID NO: 5932 - DNA, 9 bp, Artificial Sequence
  Synthetic nucleic acid molecule
gagtgaggc

SEQ ID NO: 5933 - DNA, 9 bp, Artificial Sequence
  Synthetic nucleic acid molecule
gagtgaggg

SEQ ID NO: 5934 - DNA, 9 bp, Artificial Sequence
  Synthetic nucleic acid molecule
gagtgaggg

SEQ ID NO: 5935 - DNA, 9 bp, Artificial Sequence
  Synthetic nucleic acid molecule
gagtgaggg

SEQ ID NO: 5936 - DNA, 9 bp, Artificial Sequence
  Synthetic nucleic acid molecule
cagtgagga

SEQ ID NO: 5937 - DNA, 9 bp, Artificial Sequence
  Synthetic nucleic acid molecule
gagtgaggc

SEQ ID NO: 5938 - DNA, 9 bp, Artificial Sequence
  Synthetic nucleic acid molecule
gagtgaggc

SEQ ID NO: 5939 - DNA, 9 bp, Artificial Sequence
  Synthetic nucleic acid molecule
gagtgaggg

SEQ ID NO: 5940 - DNA, 9 bp, Artificial Sequence
  Synthetic nucleic acid molecule
gagggagga

SEQ ID NO: 5941 - DNA, 9 bp, Artificial Sequence
  Synthetic nucleic acid molecule
gagtgaaga

SEQ ID NO: 5942 - DNA, 9 bp, Artificial Sequence
  Synthetic nucleic acid molecule
gagtgaggt

SEQ ID NO: 5943 - DNA, 9 bp, Artificial Sequence
  Synthetic nucleic acid molecule
gagtgaggg

SEQ ID NO: 5944 - DNA, 9 bp, Artificial Sequence
  Synthetic nucleic acid molecule
gagtgaggg

SEQ ID NO: 5945 - DNA, 9 bp, Artificial Sequence
  Synthetic nucleic acid molecule
gagtgaggt

SEQ ID NO: 5946 - DNA, 9 bp, Artificial Sequence
  Synthetic nucleic acid molecule
gagtgtgga

SEQ ID NO: 5947 - DNA, 9 bp, Artificial Sequence
  Synthetic nucleic acid molecule
gagtgaggg

SEQ ID NO: 5948 - DNA, 9 bp, Artificial Sequence
  Synthetic nucleic acid molecule
gagtgaggc

SEQ ID NO: 5949 - DNA, 9 bp, Artificial Sequence
  Synthetic nucleic acid molecule
gagtgaggc

SEQ ID NO: 5950 - DNA, 9 bp, Artificial Sequence
  Synthetic nucleic acid molecule
gagtgagca

SEQ ID NO: 5951 - DNA, 9 bp, Artificial Sequence
  Synthetic nucleic acid molecule
gagtgaggt

SEQ ID NO: 5952 - DNA, 9 bp, Artificial Sequence
  Synthetic nucleic acid molecule
gagtgaggt

SEQ ID NO: 5953 - DNA, 9 bp, Artificial Sequence
  Synthetic nucleic acid molecule
gagtgaggc

SEQ ID NO: 5954 - DNA, 9 bp, Artificial Sequence
  Synthetic nucleic acid molecule
gagtgagaa

SEQ ID NO: 5955 - DNA, 9 bp, Artificial Sequence
  Synthetic nucleic acid molecule
gagtgaggg

SEQ ID NO: 5956 - DNA, 9 bp, Artificial Sequence
  Synthetic nucleic acid molecule
aagtgagga

SEQ ID NO: 5957 - DNA, 9 bp, Artificial Sequence
  Synthetic nucleic acid molecule
gagtgaggc

SEQ ID NO: 5958 - DNA, 9 bp, Artificial Sequence
  Synthetic nucleic acid molecule
aagtgagga

SEQ ID NO: 5959 - DNA, 9 bp, Artificial Sequence
  Synthetic nucleic acid molecule
gagtgaggg

SEQ ID NO: 5960 - DNA, 9 bp, Artificial Sequence
  Synthetic nucleic acid molecule
gagtgaggt

SEQ ID NO: 5961 - DNA, 9 bp, Artificial Sequence
  Synthetic nucleic acid molecule
gagtgaggt

SEQ ID NO: 5962 - DNA, 9 bp, Artificial Sequence
  Synthetic nucleic acid molecule
gagtgaggt

SEQ ID NO: 5963 - DNA, 9 bp, Artificial Sequence
  Synthetic nucleic acid molecule
gagtgaggt

SEQ ID NO: 5964 - DNA, 9 bp, Artificial Sequence
  Synthetic nucleic acid molecule
gagtgaggg

SEQ ID NO: 5965 - DNA, 9 bp, Artificial Sequence
  Synthetic nucleic acid molecule
gagtgaggg

SEQ ID NO: 5966 - DNA, 9 bp, Artificial Sequence
  Synthetic nucleic acid molecule
aagtgagga

SEQ ID NO: 5967 - DNA, 9 bp, Artificial Sequence
  Synthetic nucleic acid molecule
gagtgaggc

SEQ ID NO: 5968 - DNA, 9 bp, Artificial Sequence
  Synthetic nucleic acid molecule
gagtgaggc

SEQ ID NO: 5969 - DNA, 9 bp, Artificial Sequence
  Synthetic nucleic acid molecule
gagtgaggt

SEQ ID NO: 5970 - DNA, 9 bp, Artificial Sequence
  Synthetic nucleic acid molecule
gagtgaggg

SEQ ID NO: 5971 - DNA, 9 bp, Artificial Sequence
  Synthetic nucleic acid molecule
gagtgaggt

SEQ ID NO: 5972 - DNA, 9 bp, Artificial Sequence
  Synthetic nucleic acid molecule
gagtgaggt

SEQ ID NO: 5973 - DNA, 9 bp, Artificial Sequence
  Synthetic nucleic acid molecule
gagtgaggc

SEQ ID NO: 5974 - DNA, 9 bp, Artificial Sequence
  Synthetic nucleic acid molecule
gagtgaggc

SEQ ID NO: 5975 - DNA, 9 bp, Artificial Sequence
  Synthetic nucleic acid molecule
gagtgaggc

SEQ ID NO: 5976 - DNA, 9 bp, Artificial Sequence
  Synthetic nucleic acid molecule
gagtgaggc

SEQ ID NO: 5977 - DNA, 9 bp, Artificial Sequence
  Synthetic nucleic acid molecule
gagtgagta

SEQ ID NO: 5978 - DNA, 9 bp, Artificial Sequence
  Synthetic nucleic acid molecule
gagtgaggc

SEQ ID NO: 5979 - DNA, 9 bp, Artificial Sequence
  Synthetic nucleic acid molecule
gagtgaggc

SEQ ID NO: 5980 - DNA, 9 bp, Artificial Sequence
  Synthetic nucleic acid molecule
gagtgaggt

SEQ ID NO: 5981 - DNA, 9 bp, Artificial Sequence
  Synthetic nucleic acid molecule
gagtgaggt

SEQ ID NO: 5982 - DNA, 9 bp, Artificial Sequence
  Synthetic nucleic acid molecule
gagtgaggg

SEQ ID NO: 5983 - DNA, 9 bp, Artificial Sequence
  Synthetic nucleic acid molecule
gagtgaggc

SEQ ID NO: 5984 - DNA, 9 bp, Artificial Sequence
  Synthetic nucleic acid molecule
gagtgagaa

SEQ ID NO: 5985 - DNA, 9 bp, Artificial Sequence
  Synthetic nucleic acid molecule
gagggagga

SEQ ID NO: 5986 - DNA, 9 bp, Artificial Sequence
  Synthetic nucleic acid molecule
gagtgagca

SEQ ID NO: 5987 - DNA, 9 bp, Artificial Sequence
  Synthetic nucleic acid molecule
cagtgagga

SEQ ID NO: 5988 - DNA, 9 bp, Artificial Sequence
  Synthetic nucleic acid molecule
gagtgaggg

SEQ ID NO: 5989 - DNA, 9 bp, Artificial Sequence
  Synthetic nucleic acid molecule
gagtgaggt

SEQ ID NO: 5990 - DNA, 9 bp, Artificial Sequence
  Synthetic nucleic acid molecule
gagtgaggt

SEQ ID NO: 5991 - DNA, 9 bp, Artificial Sequence
  Synthetic nucleic acid molecule
gagtgaggc

SEQ ID NO: 5992 - DNA, 9 bp, Artificial Sequence
  Synthetic nucleic acid molecule
gagtgaggg

SEQ ID NO: 5993 - DNA, 9 bp, Artificial Sequence
  Synthetic nucleic acid molecule
gagtgaggc

SEQ ID NO: 5994 - DNA, 9 bp, Artificial Sequence
  Synthetic nucleic acid molecule
gagtgaggg

SEQ ID NO: 5995 - DNA, 9 bp, Artificial Sequence
  Synthetic nucleic acid molecule
gagtgaggg

SEQ ID NO: 5996 - DNA, 9 bp, Artificial Sequence
  Synthetic nucleic acid molecule
gagtgaggc

SEQ ID NO: 5997 - DNA, 9 bp, Artificial Sequence
  Synthetic nucleic acid molecule
gagtgaggg

SEQ ID NO: 5998 - DNA, 9 bp, Artificial Sequence
  Synthetic nucleic acid molecule
gagtgagaa

SEQ ID NO: 5999 - DNA, 9 bp, Artificial Sequence
  Synthetic nucleic acid molecule
gagtgaggt

SEQ ID NO: 6000 - DNA, 9 bp, Artificial Sequence
  Synthetic nucleic acid molecule
gagtgaggc

SEQ ID NO: 6001 - DNA, 9 bp, Artificial Sequence
  Synthetic nucleic acid molecule
gagtgaggt

SEQ ID NO: 6002 - DNA, 9 bp, Artificial Sequence
  Synthetic nucleic acid molecule
gagtgaggg

SEQ ID NO: 6003 - DNA, 9 bp, Artificial Sequence
  Synthetic nucleic acid molecule
cagtgagga

SEQ ID NO: 6004 - DNA, 9 bp, Artificial Sequence
  Synthetic nucleic acid molecule
cagtgagga

SEQ ID NO: 6005 - DNA, 9 bp, Artificial Sequence
  Synthetic nucleic acid molecule
gagtgaggg

SEQ ID NO: 6006 - DNA, 9 bp, Artificial Sequence
  Synthetic nucleic acid molecule
gagtgaggc

SEQ ID NO: 6007 - DNA, 9 bp, Artificial Sequence
  Synthetic nucleic acid molecule
gagtgaggc

SEQ ID NO: 6008 - DNA, 9 bp, Artificial Sequence
  Synthetic nucleic acid molecule
gagtgaggc

SEQ ID NO: 6009 - DNA, 9 bp, Artificial Sequence
  Synthetic nucleic acid molecule
gagtgaggg

SEQ ID NO: 6010 - DNA, 9 bp, Artificial Sequence
  Synthetic nucleic acid molecule
gagtgaggg

SEQ ID NO: 6011 - DNA, 9 bp, Artificial Sequence
  Synthetic nucleic acid molecule
gagtgagta

SEQ ID NO: 6012 - DNA, 9 bp, Artificial Sequence
  Synthetic nucleic acid molecule
gagtgaggg

SEQ ID NO: 6013 - DNA, 9 bp, Artificial Sequence
  Synthetic nucleic acid molecule
gagtgaggg

SEQ ID NO: 6014 - DNA, 9 bp, Artificial Sequence
  Synthetic nucleic acid molecule
gagtgagta

SEQ ID NO: 6015 - DNA, 9 bp, Artificial Sequence
  Synthetic nucleic acid molecule
gagtgaggt

SEQ ID NO: 6016 - DNA, 9 bp, Artificial Sequence
  Synthetic nucleic acid molecule
gagtgaggg

SEQ ID NO: 6017 - DNA, 9 bp, Artificial Sequence
  Synthetic nucleic acid molecule
gagtgaggc

SEQ ID NO: 6018 - DNA, 9 bp, Artificial Sequence
  Synthetic nucleic acid molecule
tagtgagga

SEQ ID NO: 6019 - DNA, 9 bp, Artificial Sequence
  Synthetic nucleic acid molecule
gagtgaggc

SEQ ID NO: 6020 - DNA, 9 bp, Artificial Sequence
  Synthetic nucleic acid molecule
gagtgagga

SEQ ID NO: 6021 - DNA, 9 bp, Artificial Sequence
  Synthetic nucleic acid molecule
gagtgagga

SEQ ID NO: 6022 - DNA, 9 bp, Artificial Sequence
  Synthetic nucleic acid molecule
gagtgagga

SEQ ID NO: 6023 - DNA, 9 bp, Artificial Sequence
  Synthetic nucleic acid molecule
gagtgagga

SEQ ID NO: 6024 - DNA, 9 bp, Artificial Sequence
  Synthetic nucleic acid molecule
gagtgagga

SEQ ID NO: 6025 - DNA, 9 bp, Artificial Sequence
  Synthetic nucleic acid molecule
gagtgagga

SEQ ID NO: 6026 - DNA, 9 bp, Artificial Sequence
  Synthetic nucleic acid molecule
gagtgagga

SEQ ID NO: 6027 - DNA, 9 bp, Artificial Sequence
  Synthetic nucleic acid molecule
gagtgagga

SEQ ID NO: 6028 - DNA, 9 bp, Artificial Sequence
  Synthetic nucleic acid molecule
gagtgagga

SEQ ID NO: 6029 - DNA, 9 bp, Artificial Sequence
  Synthetic nucleic acid molecule
gagtgagga

SEQ ID NO: 6030 - DNA, 9 bp, Artificial Sequence
  Synthetic nucleic acid molecule
gagtgagga

SEQ ID NO: 6031 - DNA, 9 bp, Artificial Sequence
  Synthetic nucleic acid molecule
gagtgagga

SEQ ID NO: 6032 - DNA, 9 bp, Artificial Sequence
  Synthetic nucleic acid molecule
gagtgagga

SEQ ID NO: 6033 - DNA, 9 bp, Artificial Sequence
  Synthetic nucleic acid molecule
gagtgagga

SEQ ID NO: 6034 - DNA, 9 bp, Artificial Sequence
  Synthetic nucleic acid molecule
gagtgagga

SEQ ID NO: 6035 - DNA, 9 bp, Artificial Sequence
  Synthetic nucleic acid molecule
gagtgagga

SEQ ID NO: 6036 - DNA, 9 bp, Artificial Sequence
  Synthetic nucleic acid molecule
gagtgagga

SEQ ID NO: 6037 - DNA, 9 bp, Artificial Sequence
  Synthetic nucleic acid molecule
gagtgagga

SEQ ID NO: 6038 - DNA, 9 bp, Artificial Sequence
  Synthetic nucleic acid molecule
gagtgagga

SEQ ID NO: 6039 - DNA, 9 bp, Artificial Sequence
  Synthetic nucleic acid molecule
gagtgagga

SEQ ID NO: 6040 - DNA, 9 bp, Artificial Sequence
  Synthetic nucleic acid molecule
gagtgagga

SEQ ID NO: 6041 - DNA, 9 bp, Artificial Sequence
  Synthetic nucleic acid molecule
gagtgagga

SEQ ID NO: 6042 - DNA, 9 bp, Artificial Sequence
  Synthetic nucleic acid molecule
gagtgagga

SEQ ID NO: 6043 - DNA, 9 bp, Artificial Sequence
  Synthetic nucleic acid molecule
gagtgagga

SEQ ID NO: 6044 - DNA, 9 bp, Artificial Sequence
  Synthetic nucleic acid molecule
gagtgagga

SEQ ID NO: 6045 - DNA, 9 bp, Artificial Sequence
  Synthetic nucleic acid molecule
gagtgagga

SEQ ID NO: 6046 - DNA, 9 bp, Artificial Sequence
  Synthetic nucleic acid molecule
gagtgagga

SEQ ID NO: 6047 - DNA, 9 bp, Artificial Sequence
  Synthetic nucleic acid molecule
gagtgagga

SEQ ID NO: 6048 - DNA, 9 bp, Artificial Sequence
  Synthetic nucleic acid molecule
gagtgagga

SEQ ID NO: 6049 - DNA, 9 bp, Artificial Sequence
  Synthetic nucleic acid molecule
gagtgagga

SEQ ID NO: 6050 - DNA, 9 bp, Artificial Sequence
  Synthetic nucleic acid molecule
gagtgagga

SEQ ID NO: 6051 - DNA, 9 bp, Artificial Sequence
  Synthetic nucleic acid molecule
gagtgagga

SEQ ID NO: 6052 - DNA, 9 bp, Artificial Sequence
  Synthetic nucleic acid molecule
gagtgagga

SEQ ID NO: 6053 - DNA, 9 bp, Artificial Sequence
  Synthetic nucleic acid molecule
gagtgagga

SEQ ID NO: 6054 - DNA, 9 bp, Artificial Sequence
  Synthetic nucleic acid molecule
gagtgagga

SEQ ID NO: 6055 - DNA, 9 bp, Artificial Sequence
  Synthetic nucleic acid molecule
gagtgagga

SEQ ID NO: 6056 - DNA, 9 bp, Artificial Sequence
  Synthetic nucleic acid molecule
gagtgagga

SEQ ID NO: 6057 - DNA, 9 bp, Artificial Sequence
  Synthetic nucleic acid molecule
gagtgagga

SEQ ID NO: 6058 - DNA, 9 bp, Artificial Sequence
  Synthetic nucleic acid molecule
gagtgagga

SEQ ID NO: 6059 - DNA, 9 bp, Artificial Sequence
  Synthetic nucleic acid molecule
gagtgagga

SEQ ID NO: 6060 - DNA, 9 bp, Artificial Sequence
  Synthetic nucleic acid molecule
gagtgagga

SEQ ID NO: 6061 - DNA, 9 bp, Artificial Sequence
  Synthetic nucleic acid molecule
gagtgagga

SEQ ID NO: 6062 - DNA, 9 bp, Artificial Sequence
  Synthetic nucleic acid molecule
gagtgagga

SEQ ID NO: 6063 - DNA, 9 bp, Artificial Sequence
  Synthetic nucleic acid molecule
gagtgagga

SEQ ID NO: 6064 - DNA, 9 bp, Artificial Sequence
  Synthetic nucleic acid molecule
gagtgagga

SEQ ID NO: 6065 - DNA, 9 bp, Artificial Sequence
  Synthetic nucleic acid molecule
gagtgagga

SEQ ID NO: 6066 - DNA, 9 bp, Artificial Sequence
  Synthetic nucleic acid molecule
cagaaaggt

SEQ ID NO: 6067 - DNA, 9 bp, Artificial Sequence
  Synthetic nucleic acid molecule
tagtgagac

SEQ ID NO: 6068 - DNA, 9 bp, Artificial Sequence
  Synthetic nucleic acid molecule
ttgtgaggg

SEQ ID NO: 6069 - DNA, 9 bp, Artificial Sequence
  Synthetic nucleic acid molecule
ttgtgaggg

SEQ ID NO: 6070 - DNA, 9 bp, Artificial Sequence
  Synthetic nucleic acid molecule
gagggagat

SEQ ID NO: 6071 - DNA, 9 bp, Artificial Sequence
  Synthetic nucleic acid molecule
gagggagat

SEQ ID NO: 6072 - DNA, 9 bp, Artificial Sequence
  Synthetic nucleic acid molecule
ttgtgaggt

SEQ ID NO: 6073 - DNA, 9 bp, Artificial Sequence
  Synthetic nucleic acid molecule
ttgtgaggt

SEQ ID NO: 6074 - DNA, 9 bp, Artificial Sequence
  Synthetic nucleic acid molecule
tagtgaata

SEQ ID NO: 6075 - DNA, 9 bp, Artificial Sequence
  Synthetic nucleic acid molecule
ttgtgaggg

SEQ ID NO: 6076 - DNA, 9 bp, Artificial Sequence
  Synthetic nucleic acid molecule
gagggagat

SEQ ID NO: 6077 - DNA, 9 bp, Artificial Sequence
  Synthetic nucleic acid molecule
aagtaaggg

SEQ ID NO: 6078 - DNA, 9 bp, Artificial Sequence
  Synthetic nucleic acid molecule
gagtgagag

SEQ ID NO: 6079 - DNA, 9 bp, Artificial Sequence
  Synthetic nucleic acid molecule
gagtgagtc

SEQ ID NO: 6080 - DNA, 9 bp, Artificial Sequence
  Synthetic nucleic acid molecule
gagtgagcc

SEQ ID NO: 6081 - DNA, 9 bp, Artificial Sequence
  Synthetic nucleic acid molecule
gagtgagtc

SEQ ID NO: 6082 - DNA, 9 bp, Artificial Sequence
  Synthetic nucleic acid molecule
gagtgagtc

SEQ ID NO: 6083 - DNA, 9 bp, Artificial Sequence
  Synthetic nucleic acid molecule
gagtgagtc

SEQ ID NO: 6084 - DNA, 9 bp, Artificial Sequence
  Synthetic nucleic acid molecule
gagtaaggg

SEQ ID NO: 6085 - DNA, 9 bp, Artificial Sequence
  Synthetic nucleic acid molecule
gagtgagag

SEQ ID NO: 6086 - DNA, 9 bp, Artificial Sequence
  Synthetic nucleic acid molecule
gagggaggg

SEQ ID NO: 6087 - DNA, 9 bp, Artificial Sequence
  Synthetic nucleic acid molecule
gagtgagag

SEQ ID NO: 6088 - DNA, 9 bp, Artificial Sequence
  Synthetic nucleic acid molecule
gagtgagat

SEQ ID NO: 6089 - DNA, 9 bp, Artificial Sequence
  Synthetic nucleic acid molecule
gagggaggt

SEQ ID NO: 6090 - DNA, 9 bp, Artificial Sequence
  Synthetic nucleic acid molecule
gagtgtggt

SEQ ID NO: 6091 - DNA, 9 bp, Artificial Sequence
  Synthetic nucleic acid molecule
gagggaggg

SEQ ID NO: 6092 - DNA, 9 bp, Artificial Sequence
  Synthetic nucleic acid molecule
gagtaaggg

SEQ ID NO: 6093 - DNA, 9 bp, Artificial Sequence
  Synthetic nucleic acid molecule
gagtgagtg

SEQ ID NO: 6094 - DNA, 9 bp, Artificial Sequence
  Synthetic nucleic acid molecule
gagggaggt

SEQ ID NO: 6095 - DNA, 9 bp, Artificial Sequence
  Synthetic nucleic acid molecule
gagtaaggg

SEQ ID NO: 6096 - DNA, 9 bp, Artificial Sequence
  Synthetic nucleic acid molecule
gagtgagag

SEQ ID NO: 6097 - DNA, 9 bp, Artificial Sequence
  Synthetic nucleic acid molecule
gagtgaggg

SEQ ID NO: 6098 - DNA, 9 bp, Artificial Sequence
  Synthetic nucleic acid molecule
gagtgaggt

SEQ ID NO: 6099 - DNA, 9 bp, Artificial Sequence
  Synthetic nucleic acid molecule
gagtgaggc

SEQ ID NO: 6100 - DNA, 9 bp, Artificial Sequence
  Synthetic nucleic acid molecule
gagtgaggc

SEQ ID NO: 6101 - DNA, 9 bp, Artificial Sequence
  Synthetic nucleic acid molecule
gagtgaggc

SEQ ID NO: 6102 - DNA, 9 bp, Artificial Sequence
  Synthetic nucleic acid molecule
gagtgaggg

SEQ ID NO: 6103 - DNA, 9 bp, Artificial Sequence
  Synthetic nucleic acid molecule
gagtgaggg

SEQ ID NO: 6104 - DNA, 9 bp, Artificial Sequence
  Synthetic nucleic acid molecule
gagtgaggc

SEQ ID NO: 6105 - DNA, 9 bp, Artificial Sequence
  Synthetic nucleic acid molecule
gagtgaggc

SEQ ID NO: 6106 - DNA, 9 bp, Artificial Sequence
  Synthetic nucleic acid molecule
gagtgaggg

SEQ ID NO: 6107 - DNA, 9 bp, Artificial Sequence
  Synthetic nucleic acid molecule
gagtgaggc

SEQ ID NO: 6108 - DNA, 9 bp, Artificial Sequence
  Synthetic nucleic acid molecule
gagtgaggc

SEQ ID NO: 6109 - DNA, 9 bp, Artificial Sequence
  Synthetic nucleic acid molecule
gagtgaggc

SEQ ID NO: 6110 - DNA, 9 bp, Artificial Sequence
  Synthetic nucleic acid molecule
gagtgaggt

SEQ ID NO: 6111 - DNA, 9 bp, Artificial Sequence
  Synthetic nucleic acid molecule
gagtgaggt

SEQ ID NO: 6112 - DNA, 9 bp, Artificial Sequence
  Synthetic nucleic acid molecule
gagtgaggc

SEQ ID NO: 6113 - DNA, 9 bp, Artificial Sequence
  Synthetic nucleic acid molecule
gagtgaggt

SEQ ID NO: 6114 - DNA, 9 bp, Artificial Sequence
  Synthetic nucleic acid molecule
gagtgaggc

SEQ ID NO: 6115 - DNA, 9 bp, Artificial Sequence
  Synthetic nucleic acid molecule
gagagagga

SEQ ID NO: 6116 - DNA, 9 bp, Artificial Sequence
  Synthetic nucleic acid molecule
gagtgaggg

SEQ ID NO: 6117 - DNA, 9 bp, Artificial Sequence
  Synthetic nucleic acid molecule
gagtgaggc

SEQ ID NO: 6118 - DNA, 9 bp, Artificial Sequence
  Synthetic nucleic acid molecule
gagtgaggt

SEQ ID NO: 6119 - DNA, 9 bp, Artificial Sequence
  Synthetic nucleic acid molecule
gagtgaggc

SEQ ID NO: 6120 - DNA, 9 bp, Artificial Sequence
  Synthetic nucleic acid molecule
gagtgagag

SEQ ID NO: 6121 - DNA, 9 bp, Artificial Sequence
  Synthetic nucleic acid molecule
gagtcaggg

SEQ ID NO: 6122 - DNA, 9 bp, Artificial Sequence
  Synthetic nucleic acid molecule
gagtgagga

SEQ ID NO: 6123 - DNA, 9 bp, Artificial Sequence
  Synthetic nucleic acid molecule
gggtgaggg

SEQ ID NO: 6124 - DNA, 9 bp, Artificial Sequence
  Synthetic nucleic acid molecule
gagtgtggc

SEQ ID NO: 6125 - DNA, 9 bp, Artificial Sequence
  Synthetic nucleic acid molecule
gagtgagag

SEQ ID NO: 6126 - DNA, 9 bp, Artificial Sequence
  Synthetic nucleic acid molecule
gagtgagag

SEQ ID NO: 6127 - DNA, 9 bp, Artificial Sequence
  Synthetic nucleic acid molecule
gagggaggt

SEQ ID NO: 6128 - DNA, 9 bp, Artificial Sequence
  Synthetic nucleic acid molecule
gagtgagag

SEQ ID NO: 6129 - DNA, 9 bp, Artificial Sequence
  Synthetic nucleic acid molecule
gggtgaggc

SEQ ID NO: 6130 - DNA, 9 bp, Artificial Sequence
  Synthetic nucleic acid molecule
gagtgaggt

SEQ ID NO: 6131 - DNA, 9 bp, Artificial Sequence
  Synthetic nucleic acid molecule
gagtgaggc

SEQ ID NO: 6132 - DNA, 9 bp, Artificial Sequence
  Synthetic nucleic acid molecule
gactgagga

SEQ ID NO: 6133 - DNA, 9 bp, Artificial Sequence
  Synthetic nucleic acid molecule
gtgtgggga

SEQ ID NO: 6134 - DNA, 9 bp, Artificial Sequence
  Synthetic nucleic acid molecule
gtgtgggga

SEQ ID NO: 6135 - DNA, 9 bp, Artificial Sequence
  Synthetic nucleic acid molecule
gagtgaggt

SEQ ID NO: 6136 - DNA, 9 bp, Artificial Sequence
  Synthetic nucleic acid molecule
gagtgaggt

SEQ ID NO: 6137 - DNA, 9 bp, Artificial Sequence
  Synthetic nucleic acid molecule
gagtgagga

SEQ ID NO: 6138 - DNA, 9 bp, Artificial Sequence
  Synthetic nucleic acid molecule
gacactgga

SEQ ID NO: 6139 - DNA, 9 bp, Artificial Sequence
  Synthetic nucleic acid molecule
aggtgaggc

SEQ ID NO: 6140 - DNA, 9 bp, Artificial Sequence
  Synthetic nucleic acid molecule
gagggtaga

SEQ ID NO: 6141 - DNA, 9 bp, Artificial Sequence
  Synthetic nucleic acid molecule
gggtgaggc

SEQ ID NO: 6142 - DNA, 9 bp, Artificial Sequence
  Synthetic nucleic acid molecule
gagtgaaga

SEQ ID NO: 6143 - DNA, 9 bp, Artificial Sequence
  Synthetic nucleic acid molecule
gagtgaggc

SEQ ID NO: 6144 - DNA, 9 bp, Artificial Sequence
  Synthetic nucleic acid molecule
gagtgaggc

SEQ ID NO: 6145 - DNA, 9 bp, Artificial Sequence
  Synthetic nucleic acid molecule
gagtgaggg

SEQ ID NO: 6146 - DNA, 9 bp, Artificial Sequence
  Synthetic nucleic acid molecule
aagtgagga

SEQ ID NO: 6147 - DNA, 9 bp, Artificial Sequence
  Synthetic nucleic acid molecule
gagtgaggc

SEQ ID NO: 6148 - DNA, 9 bp, Artificial Sequence
  Synthetic nucleic acid molecule
gagtgatga

SEQ ID NO: 6149 - DNA, 9 bp, Artificial Sequence
  Synthetic nucleic acid molecule
aagtgagga

SEQ ID NO: 6150 - DNA, 9 bp, Artificial Sequence
  Synthetic nucleic acid molecule
gagtgaggg

SEQ ID NO: 6151 - DNA, 9 bp, Artificial Sequence
  Synthetic nucleic acid molecule
gagtgagga

SEQ ID NO: 6152 - DNA, 9 bp, Artificial Sequence
  Synthetic nucleic acid molecule
gagtgaggc

SEQ ID NO: 6153 - DNA, 23 bp, Artificial Sequence
  Synthetic nucleic acid molecule
agcagcttccttttgagtgagaa

SEQ ID NO: 6154 - DNA, 24 bp, Artificial Sequence
  Synthetic nucleic acid molecule
agcatcgtcatcagacagtgagga

SEQ ID NO: 6155 - DNA, 23 bp, Artificial Sequence
  Synthetic nucleic acid molecule
agcaacgtcgtagtgattgagga

SEQ ID NO: 6156 - DNA, 23 bp, Artificial Sequence
  Synthetic nucleic acid molecule
agctgggtcatgaggagtgagga

SEQ ID NO: 6157 - DNA, 23 bp, Artificial Sequence
  Synthetic nucleic acid molecule
agctgggtcatgaggagtgagga

SEQ ID NO: 6158 - DNA, 24 bp, Artificial Sequence
  Synthetic nucleic acid molecule
agcaacttctggaaagagtgagga

SEQ ID NO: 6159 - DNA, 23 bp, Artificial Sequence
  Synthetic nucleic acid molecule
agctgagtcttaaggagtgagga

SEQ ID NO: 6160 - DNA, 24 bp, Artificial Sequence
  Synthetic nucleic acid molecule
tccagcgtcctcccagagtgagga

SEQ ID NO: 6161 - DNA, 24 bp, Artificial Sequence
  Synthetic nucleic acid molecule
tgcagcgttaaaatagagtgagga

SEQ ID NO: 6162 - DNA, 23 bp, Artificial Sequence
  Synthetic nucleic acid molecule
agcaccttcaattggagtgagga

SEQ ID NO: 6163 - DNA, 24 bp, Artificial Sequence
  Synthetic nucleic acid molecule
tgcagcggcgtaggggagtgagga

SEQ ID NO: 6164 - DNA, 24 bp, Artificial Sequence
  Synthetic nucleic acid molecule
agcagggttcttcaagagtgagga

SEQ ID NO: 6165 - DNA, 24 bp, Artificial Sequence
  Synthetic nucleic acid molecule
agcagcatagatatggagtgagga

SEQ ID NO: 6166 - DNA, 24 bp, Artificial Sequence
  Synthetic nucleic acid molecule
aacagcttctctgaggagtgagga

SEQ ID NO: 6167 - DNA, 24 bp, Artificial Sequence
  Synthetic nucleic acid molecule
tgcagggtcgggcaggagtgagga

SEQ ID NO: 6168 - DNA, 23 bp, Artificial Sequence
  Synthetic nucleic acid molecule
agcaaagtcaaacagagtgagga

SEQ ID NO: 6169 - DNA, 24 bp, Artificial Sequence
  Synthetic nucleic acid molecule
aacagcttctcgggagagtgagga

SEQ ID NO: 6170 - DNA, 23 bp, Artificial Sequence
  Synthetic nucleic acid molecule
agtagcggcaaattgagtgagga

SEQ ID NO: 6171 - DNA, 23 bp, Artificial Sequence
  Synthetic nucleic acid molecule
agctgagtcctaaagagtgagga

SEQ ID NO: 6172 - DNA, 23 bp, Artificial Sequence
  Synthetic nucleic acid molecule
agcagcgagaaagagagtgagga

SEQ ID NO: 6173 - DNA, 23 bp, Artificial Sequence
  Synthetic nucleic acid molecule
tgcagtgtccacaagagtgagga

SEQ ID NO: 6174 - DNA, 24 bp, Artificial Sequence
  Synthetic nucleic acid molecule
agcagcataatagcagagtgagga

SEQ ID NO: 6175 - DNA, 23 bp, Artificial Sequence
  Synthetic nucleic acid molecule
agcagcatatcagggagtgagga

SEQ ID NO: 6176 - DNA, 23 bp, Artificial Sequence
  Synthetic nucleic acid molecule
agcagcggtcttaggagtgagga

SEQ ID NO: 6177 - DNA, 24 bp, Artificial Sequence
  Synthetic nucleic acid molecule
aacagcttcatctcggagtgagga

SEQ ID NO: 6178 - DNA, 23 bp, Artificial Sequence
  Synthetic nucleic acid molecule
ggcagagtcctagagagtgagga

SEQ ID NO: 6179 - DNA, 23 bp, Artificial Sequence
  Synthetic nucleic acid molecule
agctgtgtcttggagagtgagga

SEQ ID NO: 6180 - DNA, 23 bp, Artificial Sequence
  Synthetic nucleic acid molecule
agtggcgtcccagtgagtgagga

SEQ ID NO: 6181 - DNA, 23 bp, Artificial Sequence
  Synthetic nucleic acid molecule
agctgtgtccacaggagtgagga

SEQ ID NO: 6182 - DNA, 24 bp, Artificial Sequence
  Synthetic nucleic acid molecule
agcagcggcttaagggggtgaggt

SEQ ID NO: 6183 - DNA, 24 bp, Artificial Sequence
  Synthetic nucleic acid molecule
agcaacgtctaacccgagtgttga

SEQ ID NO: 6184 - DNA, 23 bp, Artificial Sequence
  Synthetic nucleic acid molecule
agcaccgtccccctcagtgaggc

SEQ ID NO: 6185 - DNA, 23 bp, Artificial Sequence
  Synthetic nucleic acid molecule
agcagcggcggctgcagtgaggc

SEQ ID NO: 6186 - DNA, 24 bp, Artificial Sequence
  Synthetic nucleic acid molecule
agcagtgtctaaaaggagtgagat

SEQ ID NO: 6187 - DNA, 24 bp, Artificial Sequence
  Synthetic nucleic acid molecule
agcaacgtccatagtgtgtgagaa

SEQ ID NO: 6188 - DNA, 24 bp, Artificial Sequence
  Synthetic nucleic acid molecule
agaaacgtcgtggaggagtgaggg

SEQ ID NO: 6189 - DNA, 24 bp, Artificial Sequence
  Synthetic nucleic acid molecule
agcatagtctaggccgagtgaggc

SEQ ID NO: 6190 - DNA, 23 bp, Artificial Sequence
  Synthetic nucleic acid molecule
agcaacttcatcttgagtgaggg

SEQ ID NO: 6191 - DNA, 23 bp, Artificial Sequence
  Synthetic nucleic acid molecule
agcagggtggcgtggagtgaggc

SEQ ID NO: 6192 - DNA, 23 bp, Artificial Sequence
  Synthetic nucleic acid molecule
agcacggtcatgatgagtgaggc

SEQ ID NO: 6193 - DNA, 23 bp, Artificial Sequence
  Synthetic nucleic acid molecule
agcattgtctcctggagtgaggg

SEQ ID NO: 6194 - DNA, 23 bp, Artificial Sequence
  Synthetic nucleic acid molecule
agcaccgtggcttcgagtgaggc

SEQ ID NO: 6195 - DNA, 23 bp, Artificial Sequence
  Synthetic nucleic acid molecule
agcaacttcctggcgagtgaggg

SEQ ID NO: 6196 - DNA, 24 bp, Artificial Sequence
  Synthetic nucleic acid molecule
agcaacatctggttggagtgaggg

SEQ ID NO: 6197 - DNA, 24 bp, Artificial Sequence
  Synthetic nucleic acid molecule
ggcagcggccgctgtgagtgaggt

SEQ ID NO: 6198 - DNA, 24 bp, Artificial Sequence
  Synthetic nucleic acid molecule
agcattgtctcatgtgagtgaggt

SEQ ID NO: 6199 - DNA, 23 bp, Artificial Sequence
  Synthetic nucleic acid molecule
agcagcagctaggggagtgaggg

SEQ ID NO: 6200 - DNA, 24 bp, Artificial Sequence
  Synthetic nucleic acid molecule
agcagcagcccacaggagtgaggg

SEQ ID NO: 6201 - DNA, 23 bp, Artificial Sequence
  Synthetic nucleic acid molecule
atcagagtctctgggagtgaggc

SEQ ID NO: 6202 - DNA, 24 bp, Artificial Sequence
  Synthetic nucleic acid molecule
atcagtgtccctcaggagtgaggc

SEQ ID NO: 6203 - DNA, 23 bp, Artificial Sequence
  Synthetic nucleic acid molecule
agcaacatcatcttgagtgaggg

SEQ ID NO: 6204 - DNA, 23 bp, Artificial Sequence
  Synthetic nucleic acid molecule
agcatggtcccaaggagtgaggg

SEQ ID NO: 6205 - DNA, 24 bp, Artificial Sequence
  Synthetic nucleic acid molecule
agcaaagtctgtactgagtgaggg

SEQ ID NO: 6206 - DNA, 23 bp, Artificial Sequence
  Synthetic nucleic acid molecule
agcagctcctctccgagtgaggt

SEQ ID NO: 6207 - DNA, 23 bp, Artificial Sequence
  Synthetic nucleic acid molecule
agcaatgtcaaaaagagtgaggc

SEQ ID NO: 6208 - DNA, 23 bp, Artificial Sequence
  Synthetic nucleic acid molecule
agtagcgtttttaggagtgaggt

SEQ ID NO: 6209 - DNA, 24 bp, Artificial Sequence
  Synthetic nucleic acid molecule
ggcagagtcagggctgagtgaggc

SEQ ID NO: 6210 - DNA, 23 bp, Artificial Sequence
  Synthetic nucleic acid molecule
tgcagcttcatggtgagtgaggc

SEQ ID NO: 6211 - DNA, 24 bp, Artificial Sequence
  Synthetic nucleic acid molecule
agcatagttacctgggagtgagga

SEQ ID NO: 6212 - DNA, 24 bp, Artificial Sequence
  Synthetic nucleic acid molecule
agtaaagtctaagtagagtgagga

SEQ ID NO: 6213 - DNA, 23 bp, Artificial Sequence
  Synthetic nucleic acid molecule
agcattgttctgcggagtgagga

SEQ ID NO: 6214 - DNA, 23 bp, Artificial Sequence
  Synthetic nucleic acid molecule
tgcagtctccttgggagtgaggt

SEQ ID NO: 6215 - DNA, 24 bp, Artificial Sequence
  Synthetic nucleic acid molecule
agcagcgtccacttccagagagga

SEQ ID NO: 6216 - DNA, 24 bp, Artificial Sequence
  Synthetic nucleic acid molecule
agcagcgtggacccagagtgagca

SEQ ID NO: 6217 - DNA, 23 bp, Artificial Sequence
  Synthetic nucleic acid molecule
agcagcgccaatccgagtgagaa

SEQ ID NO: 6218 - DNA, 23 bp, Artificial Sequence
  Synthetic nucleic acid molecule
agcagcggcaggctgagagagga

SEQ ID NO: 6219 - DNA, 24 bp, Artificial Sequence
  Synthetic nucleic acid molecule
agcagcttctgccttgagtgagta

SEQ ID NO: 6220 - DNA, 23 bp, Artificial Sequence
  Synthetic nucleic acid molecule
agcagcttcactgtcagtgagga

SEQ ID NO: 6221 - DNA, 23 bp, Artificial Sequence
  Synthetic nucleic acid molecule
atcagcgtcttcagaagtgagga

SEQ ID NO: 6222 - DNA, 24 bp, Artificial Sequence
  Synthetic nucleic acid molecule
agcagcgtggacccagagtgagca

SEQ ID NO: 6223 - DNA, 24 bp, Artificial Sequence
  Synthetic nucleic acid molecule
agcagggtcaagaaagagtgagta

SEQ ID NO: 6224 - DNA, 23 bp, Artificial Sequence
  Synthetic nucleic acid molecule
agcagcgttacacagagtgggga

SEQ ID NO: 6225 - DNA, 24 bp, Artificial Sequence
  Synthetic nucleic acid molecule
agcagcggcaagagagaatgagga

SEQ ID NO: 6226 - DNA, 23 bp, Artificial Sequence
  Synthetic nucleic acid molecule
agcagagtccaggcaagtgagga

SEQ ID NO: 6227 - DNA, 23 bp, Artificial Sequence
  Synthetic nucleic acid molecule
agcagagtccaggcaagtgagga

SEQ ID NO: 6228 - DNA, 24 bp, Artificial Sequence
  Synthetic nucleic acid molecule
agcagggtctgggtagagtgatga

SEQ ID NO: 6229 - DNA, 24 bp, Artificial Sequence
  Synthetic nucleic acid molecule
agcagcgtggacccagagtgagca

SEQ ID NO: 6230 - DNA, 24 bp, Artificial Sequence
  Synthetic nucleic acid molecule
agcagcagctagctagagtgagga

SEQ ID NO: 6231 - DNA, 23 bp, Artificial Sequence
  Synthetic nucleic acid molecule
aggagcttcactaagagtgagga

SEQ ID NO: 6232 - DNA, 23 bp, Artificial Sequence
  Synthetic nucleic acid molecule
agcagcctgcaatagagtgagga

SEQ ID NO: 6233 - DNA, 24 bp, Artificial Sequence
  Synthetic nucleic acid molecule
accagtgtctgagctgagtgagga

SEQ ID NO: 6234 - DNA, 23 bp, Artificial Sequence
  Synthetic nucleic acid molecule
aacagagtccccatgagtgagga

SEQ ID NO: 6235 - DNA, 24 bp, Artificial Sequence
  Synthetic nucleic acid molecule
agcagcctggccagggagtgagga

SEQ ID NO: 6236 - DNA, 23 bp, Artificial Sequence
  Synthetic nucleic acid molecule
agcagcagcagtgagagtgagga

SEQ ID NO: 6237 - DNA, 23 bp, Artificial Sequence
  Synthetic nucleic acid molecule
atcagagtcttagggagtgagga

SEQ ID NO: 6238 - DNA, 24 bp, Artificial Sequence
  Synthetic nucleic acid molecule
agcggggtctagggggagtgagga

SEQ ID NO: 6239 - DNA, 23 bp, Artificial Sequence
  Synthetic nucleic acid molecule
agcagcggacaagtgagtgagga

SEQ ID NO: 6240 - DNA, 24 bp, Artificial Sequence
  Synthetic nucleic acid molecule
agcagcgtccctgcctagggaggg

SEQ ID NO: 6241 - DNA, 24 bp, Artificial Sequence
  Synthetic nucleic acid molecule
agcagcgtcttttctatgtgaggc

SEQ ID NO: 6242 - DNA, 24 bp, Artificial Sequence
  Synthetic nucleic acid molecule
agcagcgtcacctctgtgtggggc

SEQ ID NO: 6243 - DNA, 23 bp, Artificial Sequence
  Synthetic nucleic acid molecule
agcagcgtctaagggaggggggt

SEQ ID NO: 6244 - DNA, 23 bp, Artificial Sequence
  Synthetic nucleic acid molecule
agcagcgtcttggggtgtggggc

SEQ ID NO: 6245 - DNA, 23 bp, Artificial Sequence
  Synthetic nucleic acid molecule
agcagcgtctagagtagagaggt

SEQ ID NO: 6246 - DNA, 24 bp, Artificial Sequence
  Synthetic nucleic acid molecule
agcagggtctcccaggagtgtgaa

SEQ ID NO: 6247 - DNA, 23 bp, Artificial Sequence
  Synthetic nucleic acid molecule
agcagtgtctatttcagtgaggg

SEQ ID NO: 6248 - DNA, 24 bp, Artificial Sequence
  Synthetic nucleic acid molecule
agcagggtcagcccagagtggggg

SEQ ID NO: 6249 - DNA, 23 bp, Artificial Sequence
  Synthetic nucleic acid molecule
agcagggtcaggcacagtgaggc

SEQ ID NO: 6250 - DNA, 23 bp, Artificial Sequence
  Synthetic nucleic acid molecule
agcagggtcctctggagtggggg

SEQ ID NO: 6251 - DNA, 23 bp, Artificial Sequence
  Synthetic nucleic acid molecule
ggcagcgtccggaggagtgaagg

SEQ ID NO: 6252 - DNA, 24 bp, Artificial Sequence
  Synthetic nucleic acid molecule
ggcagcgtcactccagagttaggt

SEQ ID NO: 6253 - DNA, 24 bp, Artificial Sequence
  Synthetic nucleic acid molecule
agcagggtcattcatcagtgaggc

SEQ ID NO: 6254 - DNA, 24 bp, Artificial Sequence
  Synthetic nucleic acid molecule
agcagagtcctgtcagagggaggc

SEQ ID NO: 6255 - DNA, 23 bp, Artificial Sequence
  Synthetic nucleic acid molecule
agcagcatcttctggagtgagac

SEQ ID NO: 6256 - DNA, 23 bp, Artificial Sequence
  Synthetic nucleic acid molecule
agcatcgtctttctgtgtgaggc

SEQ ID NO: 6257 - DNA, 24 bp, Artificial Sequence
  Synthetic nucleic acid molecule
agcagtgtctcacaggagggaggg

SEQ ID NO: 6258 - DNA, 23 bp, Artificial Sequence
  Synthetic nucleic acid molecule
ggcagcgtccaggagagagaggt

SEQ ID NO: 6259 - DNA, 23 bp, Artificial Sequence
  Synthetic nucleic acid molecule
agcagcggccccgggagttaggt

SEQ ID NO: 6260 - DNA, 24 bp, Artificial Sequence
  Synthetic nucleic acid molecule
agcagcggcgggtgggagtggggg

SEQ ID NO: 6261 - DNA, 23 bp, Artificial Sequence
  Synthetic nucleic acid molecule
agcagtgtccagacgagggaggt

SEQ ID NO: 6262 - DNA, 23 bp, Artificial Sequence
  Synthetic nucleic acid molecule
agcagtgtctatgagagggaggg

SEQ ID NO: 6263 - DNA, 24 bp, Artificial Sequence
  Synthetic nucleic acid molecule
agcagtgtcagccatgagggaggg

SEQ ID NO: 6264 - DNA, 24 bp, Artificial Sequence
  Synthetic nucleic acid molecule
agcagtgtccctgtggagggaggt

SEQ ID NO: 6265 - DNA, 23 bp, Artificial Sequence
  Synthetic nucleic acid molecule
agcaccgtctgccagagtgggca

SEQ ID NO: 6266 - DNA, 23 bp, Artificial Sequence
  Synthetic nucleic acid molecule
agccacgtccacactagtgagga

SEQ ID NO: 6267 - DNA, 23 bp, Artificial Sequence
  Synthetic nucleic acid molecule
agtagcgccaaaaggagtgaggt

SEQ ID NO: 6268 - DNA, 24 bp, Artificial Sequence
  Synthetic nucleic acid molecule
aacagggtctttgacgagtgaggc

SEQ ID NO: 6269 - DNA, 23 bp, Artificial Sequence
  Synthetic nucleic acid molecule
ggcagggtctcaatgagtgaggg

SEQ ID NO: 6270 - DNA, 23 bp, Artificial Sequence
  Synthetic nucleic acid molecule
aacagggtccctgagagtgaggg

SEQ ID NO: 6271 - DNA, 23 bp, Artificial Sequence
  Synthetic nucleic acid molecule
aggagagtccaggtgagtgaggg

SEQ ID NO: 6272 - DNA, 23 bp, Artificial Sequence
  Synthetic nucleic acid molecule
agcagccgccaacagagtgaggg

SEQ ID NO: 6273 - DNA, 24 bp, Artificial Sequence
  Synthetic nucleic acid molecule
ggcagagtcagtgttgagtgaggg

SEQ ID NO: 6274 - DNA, 24 bp, Artificial Sequence
  Synthetic nucleic acid molecule
agcagtgtgtgagctgagtgaggc

SEQ ID NO: 6275 - DNA, 23 bp, Artificial Sequence
  Synthetic nucleic acid molecule
agcatcttccagtggagtgaggg

SEQ ID NO: 6276 - DNA, 23 bp, Artificial Sequence
  Synthetic nucleic acid molecule
agcagagtggttgagagtgaggt

SEQ ID NO: 6277 - DNA, 23 bp, Artificial Sequence
  Synthetic nucleic acid molecule
atcagtgtcccagagagtgaggg

SEQ ID NO: 6278 - DNA, 24 bp, Artificial Sequence
  Synthetic nucleic acid molecule
ttcagcgtccaagaagagtgaggt

SEQ ID NO: 6279 - DNA, 24 bp, Artificial Sequence
  Synthetic nucleic acid molecule
agcaacttccggacagagtaagga

SEQ ID NO: 6280 - DNA, 23 bp, Artificial Sequence
  Synthetic nucleic acid molecule
agcagcgggagatggagtgaggc

SEQ ID NO: 6281 - DNA, 23 bp, Artificial Sequence
  Synthetic nucleic acid molecule
agtagcgtggagaggagtgaggt

SEQ ID NO: 6282 - DNA, 23 bp, Artificial Sequence
  Synthetic nucleic acid molecule
agctgcatctttgggagtgaggt

SEQ ID NO: 6283 - DNA, 24 bp, Artificial Sequence
  Synthetic nucleic acid molecule
atcagagtcaaagaagagtgaggt

SEQ ID NO: 6284 - DNA, 24 bp, Artificial Sequence
  Synthetic nucleic acid molecule
agcaggatctgaaatgagtgaggt

SEQ ID NO: 6285 - DNA, 24 bp, Artificial Sequence
  Synthetic nucleic acid molecule
agccacgtccagttttagtgagga

SEQ ID NO: 6286 - DNA, 24 bp, Artificial Sequence
  Synthetic nucleic acid molecule
agcaatgtctcaaatcagtgagga

SEQ ID NO: 6287 - DNA, 23 bp, Artificial Sequence
  Synthetic nucleic acid molecule
agcaatgtctgaaacagtgagga

SEQ ID NO: 6288 - DNA, 23 bp, Artificial Sequence
  Synthetic nucleic acid molecule
ggctgcgtcatcgggagtgaggt

SEQ ID NO: 6289 - DNA, 23 bp, Artificial Sequence
  Synthetic nucleic acid molecule
ggcagagtcaaaatgagtgaggt

SEQ ID NO: 6290 - DNA, 23 bp, Artificial Sequence
  Synthetic nucleic acid molecule
agcagtgtgcatgtgagtgaggt

SEQ ID NO: 6291 - DNA, 24 bp, Artificial Sequence
  Synthetic nucleic acid molecule
ggcaacatcaaacaggagtgagga

SEQ ID NO: 6292 - DNA, 24 bp, Artificial Sequence
  Synthetic nucleic acid molecule
cccagcggctggcaggagtgagga

SEQ ID NO: 6293 - DNA, 24 bp, Artificial Sequence
  Synthetic nucleic acid molecule
agcctggtcggagaggagtgagga

SEQ ID NO: 6294 - DNA, 23 bp, Artificial Sequence
  Synthetic nucleic acid molecule
tgcagtctctatgggagtgagga

SEQ ID NO: 6295 - DNA, 23 bp, Artificial Sequence
  Synthetic nucleic acid molecule
agcattgtagaggcgagtgagga

SEQ ID NO: 6296 - DNA, 23 bp, Artificial Sequence
  Synthetic nucleic acid molecule
agcctggtctcacagagtgagga

SEQ ID NO: 6297 - DNA, 23 bp, Artificial Sequence
  Synthetic nucleic acid molecule
agcatagtgaatatgagtgagga

SEQ ID NO: 6298 - DNA, 23 bp, Artificial Sequence
  Synthetic nucleic acid molecule
agcaaaggcaccaggagtgagga

SEQ ID NO: 6299 - DNA, 23 bp, Artificial Sequence
  Synthetic nucleic acid molecule
aacatggtccacgtgagtgagga

SEQ ID NO: 6300 - DNA, 24 bp, Artificial Sequence
  Synthetic nucleic acid molecule
agctttgtcaacctagagtgagga

SEQ ID NO: 6301 - DNA, 23 bp, Artificial Sequence
  Synthetic nucleic acid molecule
agcaaaggcaaaaagagtgagga

SEQ ID NO: 6302 - DNA, 23 bp, Artificial Sequence
  Synthetic nucleic acid molecule
atcaaggtcttttggagtgagga

SEQ ID NO: 6303 - DNA, 24 bp, Artificial Sequence
  Synthetic nucleic acid molecule
gccagtgtctcgtctgagtgagga

SEQ ID NO: 6304 - DNA, 24 bp, Artificial Sequence
  Synthetic nucleic acid molecule
tgcaaagtcagatctgagtgagga

SEQ ID NO: 6305 - DNA, 23 bp, Artificial Sequence
  Synthetic nucleic acid molecule
agcaacgtctacaggaggaaggt

SEQ ID NO: 6306 - DNA, 24 bp, Artificial Sequence
  Synthetic nucleic acid molecule
agcaacgtcccaggaaagtgaagg

SEQ ID NO: 6307 - DNA, 24 bp, Artificial Sequence
  Synthetic nucleic acid molecule
ggcagtgtccagtaggagtgagat

SEQ ID NO: 6308 - DNA, 23 bp, Artificial Sequence
  Synthetic nucleic acid molecule
agcaaagtctcacaaagtgaggt

SEQ ID NO: 6309 - DNA, 24 bp, Artificial Sequence
  Synthetic nucleic acid molecule
tgctgtgtcaaacccgagtgaggt

SEQ ID NO: 6310 - DNA, 24 bp, Artificial Sequence
  Synthetic nucleic acid molecule
ggcaaggtctctgtggagtgaggg

SEQ ID NO: 6311 - DNA, 23 bp, Artificial Sequence
  Synthetic nucleic acid molecule
atcaacgtgtctcagagtgaggc

SEQ ID NO: 6312 - DNA, 24 bp, Artificial Sequence
  Synthetic nucleic acid molecule
agcagcgtctgaggcgggtgagaa

SEQ ID NO: 6313 - DNA, 24 bp, Artificial Sequence
  Synthetic nucleic acid molecule
agcagcgtctgcatggtgtgggga

SEQ ID NO: 6314 - DNA, 23 bp, Artificial Sequence
  Synthetic nucleic acid molecule
agcagagtcaggcagagtgagaa

SEQ ID NO: 6315 - DNA, 24 bp, Artificial Sequence
  Synthetic nucleic acid molecule
agcagcttcatttatgagtgagca

SEQ ID NO: 6316 - DNA, 23 bp, Artificial Sequence
  Synthetic nucleic acid molecule
ggcagcgtccttctgagtgagca

SEQ ID NO: 6317 - DNA, 23 bp, Artificial Sequence
  Synthetic nucleic acid molecule
agcagtgtcgtgaagagtcagga

SEQ ID NO: 6318 - DNA, 24 bp, Artificial Sequence
  Synthetic nucleic acid molecule
agcagcttccggggagagagagga

SEQ ID NO: 6319 - DNA, 23 bp, Artificial Sequence
  Synthetic nucleic acid molecule
agcagctgcggaccgagtgagga

SEQ ID NO: 6320 - DNA, 23 bp, Artificial Sequence
  Synthetic nucleic acid molecule
agcagtggcattaagagtgagga

SEQ ID NO: 6321 - DNA, 23 bp, Artificial Sequence
  Synthetic nucleic acid molecule
agcagcatgcacatgagtgagga

SEQ ID NO: 6322 - DNA, 23 bp, Artificial Sequence
  Synthetic nucleic acid molecule
agcagcatgaccaagagtgagga

SEQ ID NO: 6323 - DNA, 24 bp, Artificial Sequence
  Synthetic nucleic acid molecule
accagggtctgtggggagtgagga

SEQ ID NO: 6324 - DNA, 24 bp, Artificial Sequence
  Synthetic nucleic acid molecule
agcagcatgaaaagggagtgagga

SEQ ID NO: 6325 - DNA, 23 bp, Artificial Sequence
  Synthetic nucleic acid molecule
agcagggtgatggagagtgagga

SEQ ID NO: 6326 - DNA, 23 bp, Artificial Sequence
  Synthetic nucleic acid molecule
agcagtgaccgaaggagtgagga

SEQ ID NO: 6327 - DNA, 23 bp, Artificial Sequence
  Synthetic nucleic acid molecule
agcagattcctcaggagtgagga

SEQ ID NO: 6328 - DNA, 23 bp, Artificial Sequence
  Synthetic nucleic acid molecule
atcagcgtggccatgagtgagga

SEQ ID NO: 6329 - DNA, 24 bp, Artificial Sequence
  Synthetic nucleic acid molecule
agcaggggcaagagagagtgagga

SEQ ID NO: 6330 - DNA, 24 bp, Artificial Sequence
  Synthetic nucleic acid molecule
agcgccgtccacagggagtgagga

SEQ ID NO: 6331 - DNA, 23 bp, Artificial Sequence
  Synthetic nucleic acid molecule
agcagcgtcccctggagtggcca

SEQ ID NO: 6332 - DNA, 24 bp, Artificial Sequence
  Synthetic nucleic acid molecule
agcagcgtccagtgggagtgggcc

SEQ ID NO: 6333 - DNA, 24 bp, Artificial Sequence
  Synthetic nucleic acid molecule
agcagcgtccttcctcagtgagac

SEQ ID NO: 6334 - DNA, 24 bp, Artificial Sequence
  Synthetic nucleic acid molecule
agcagcggcggcggggagggaggc

SEQ ID NO: 6335 - DNA, 24 bp, Artificial Sequence
  Synthetic nucleic acid molecule
agcagagtctgttgagagtgagac

SEQ ID NO: 6336 - DNA, 23 bp, Artificial Sequence
  Synthetic nucleic acid molecule
tgcagcgtcagaaggtgtgaggc

SEQ ID NO: 6337 - DNA, 23 bp, Artificial Sequence
  Synthetic nucleic acid molecule
agcagcgtgcctctgggtgaggc

SEQ ID NO: 6338 - DNA, 24 bp, Artificial Sequence
  Synthetic nucleic acid molecule
agcagcttccatctggagtgagtc

SEQ ID NO: 6339 - DNA, 24 bp, Artificial Sequence
  Synthetic nucleic acid molecule
agcagcatctgctcttagtgaggc

SEQ ID NO: 6340 - DNA, 23 bp, Artificial Sequence
  Synthetic nucleic acid molecule
agcaacgtcctgcagagggagaa

SEQ ID NO: 6341 - DNA, 23 bp, Artificial Sequence
  Synthetic nucleic acid molecule
agcagcggcccgcagagggaggc

SEQ ID NO: 6342 - DNA, 23 bp, Artificial Sequence
  Synthetic nucleic acid molecule
agcaacgtcagcaacagtgagaa

SEQ ID NO: 6343 - DNA, 23 bp, Artificial Sequence
  Synthetic nucleic acid molecule
agtagcgtctcgaagagagaggc

SEQ ID NO: 6344 - DNA, 23 bp, Artificial Sequence
  Synthetic nucleic acid molecule
agcagcgttttcaggagggaggg

SEQ ID NO: 6345 - DNA, 23 bp, Artificial Sequence
  Synthetic nucleic acid molecule
agcagcggcaccctgggtgaggc

SEQ ID NO: 6346 - DNA, 24 bp, Artificial Sequence
  Synthetic nucleic acid molecule
agcaaggtcaactcagagtgagaa

SEQ ID NO: 6347 - DNA, 24 bp, Artificial Sequence
  Synthetic nucleic acid molecule
agcatggtcagtttctagtgagga

SEQ ID NO: 6348 - DNA, 24 bp, Artificial Sequence
  Synthetic nucleic acid molecule
agtagggtcacgccagagtgaggc

SEQ ID NO: 6349 - DNA, 23 bp, Artificial Sequence
  Synthetic nucleic acid molecule
atcagggtcctgttgagtgaggg

SEQ ID NO: 6350 - DNA, 24 bp, Artificial Sequence
  Synthetic nucleic acid molecule
agcatggtctttttctagtgagga

SEQ ID NO: 6351 - DNA, 24 bp, Artificial Sequence
  Synthetic nucleic acid molecule
agcagggtaagaggggagtgaggg

SEQ ID NO: 6352 - DNA, 24 bp, Artificial Sequence
  Synthetic nucleic acid molecule
ggcaacgtcaactcagagtgagaa

SEQ ID NO: 6353 - DNA, 24 bp, Artificial Sequence
  Synthetic nucleic acid molecule
gccagcgtcttgggtgagtgaggt

SEQ ID NO: 6354 - DNA, 23 bp, Artificial Sequence
  Synthetic nucleic acid molecule
agcagctttctgctgagtgaggc

SEQ ID NO: 6355 - DNA, 23 bp, Artificial Sequence
  Synthetic nucleic acid molecule
agcagtggctgcgggagtgaggc

SEQ ID NO: 6356 - DNA, 23 bp, Artificial Sequence
  Synthetic nucleic acid molecule
ggcagcatctgggcgagtgaggc

SEQ ID NO: 6357 - DNA, 23 bp, Artificial Sequence
  Synthetic nucleic acid molecule
ggcagcatctgaatgagtgaggc

SEQ ID NO: 6358 - DNA, 23 bp, Artificial Sequence
  Synthetic nucleic acid molecule
agcagtgtatgtgggagtgaggt

SEQ ID NO: 6359 - DNA, 23 bp, Artificial Sequence
  Synthetic nucleic acid molecule
aggagagtccctgggagtgaggc

SEQ ID NO: 6360 - DNA, 24 bp, Artificial Sequence
  Synthetic nucleic acid molecule
agcatggtcagattctagtgagga

SEQ ID NO: 6361 - DNA, 24 bp, Artificial Sequence
  Synthetic nucleic acid molecule
atcagggtcttgagggagtgaggt

SEQ ID NO: 6362 - DNA, 23 bp, Artificial Sequence
  Synthetic nucleic acid molecule
aacagcgtgctgtagagtgaggt

SEQ ID NO: 6363 - DNA, 23 bp, Artificial Sequence
  Synthetic nucleic acid molecule
agtagcttctgtgggagtgaggc

SEQ ID NO: 6364 - DNA, 23 bp, Artificial Sequence
  Synthetic nucleic acid molecule
agcaacttcttgatgagtgagaa

SEQ ID NO: 6365 - DNA, 24 bp, Artificial Sequence
  Synthetic nucleic acid molecule
agcatggtcaggttctagtgagga

SEQ ID NO: 6366 - DNA, 24 bp, Artificial Sequence
  Synthetic nucleic acid molecule
agaagtgtcagagtagagtgaggc

SEQ ID NO: 6367 - DNA, 23 bp, Artificial Sequence
  Synthetic nucleic acid molecule
aacagcggcatggggagtgaggc

SEQ ID NO: 6368 - DNA, 24 bp, Artificial Sequence
  Synthetic nucleic acid molecule
agcagtggcatctaggagtgaggc

SEQ ID NO: 6369 - DNA, 24 bp, Artificial Sequence
  Synthetic nucleic acid molecule
aaaagtgtcatataggagtgagga

SEQ ID NO: 6370 - DNA, 23 bp, Artificial Sequence
  Synthetic nucleic acid molecule
agcaatggctggatgagtgagga

SEQ ID NO: 6371 - DNA, 24 bp, Artificial Sequence
  Synthetic nucleic acid molecule
gccaccgtcggtgaggagtgagga

SEQ ID NO: 6372 - DNA, 24 bp, Artificial Sequence
  Synthetic nucleic acid molecule
aaaagtgtcagtagagagtgagga

SEQ ID NO: 6373 - DNA, 24 bp, Artificial Sequence
  Synthetic nucleic acid molecule
aacattgtctagtgggagtgagga

SEQ ID NO: 6374 - DNA, 24 bp, Artificial Sequence
  Synthetic nucleic acid molecule
aacattgtctagtgagagtgagga

SEQ ID NO: 6375 - DNA, 24 bp, Artificial Sequence
  Synthetic nucleic acid molecule
aacattgtctagtgggagtgagga

SEQ ID NO: 6376 - DNA, 24 bp, Artificial Sequence
  Synthetic nucleic acid molecule
aacattgtctagtgagagtgagga

SEQ ID NO: 6377 - DNA, 24 bp, Artificial Sequence
  Synthetic nucleic acid molecule
aacattgtctagtgggagtgagga

SEQ ID NO: 6378 - DNA, 24 bp, Artificial Sequence
  Synthetic nucleic acid molecule
aacattgtctagtgagagtgagga

SEQ ID NO: 6379 - DNA, 24 bp, Artificial Sequence
  Synthetic nucleic acid molecule
aacattgtctagtgggagtgagga

SEQ ID NO: 6380 - DNA, 24 bp, Artificial Sequence
  Synthetic nucleic acid molecule
aacattgtctagtgagagtgagga

SEQ ID NO: 6381 - DNA, 24 bp, Artificial Sequence
  Synthetic nucleic acid molecule
aacattgtctagtgggagtgagga

SEQ ID NO: 6382 - DNA, 24 bp, Artificial Sequence
  Synthetic nucleic acid molecule
aacattgtctagtgagagtgagga

SEQ ID NO: 6383 - DNA, 24 bp, Artificial Sequence
  Synthetic nucleic acid molecule
aacattgtctagtgggagtgagga

SEQ ID NO: 6384 - DNA, 24 bp, Artificial Sequence
  Synthetic nucleic acid molecule
aacattgtctagtgagagtgagga

SEQ ID NO: 6385 - DNA, 24 bp, Artificial Sequence
  Synthetic nucleic acid molecule
aacattgtctagtgggagtgagga

SEQ ID NO: 6386 - DNA, 24 bp, Artificial Sequence
  Synthetic nucleic acid molecule
aacattgtctagtgagagtgagga

SEQ ID NO: 6387 - DNA, 24 bp, Artificial Sequence
  Synthetic nucleic acid molecule
atcaacttcttcagggagtgagga

SEQ ID NO: 6388 - DNA, 23 bp, Artificial Sequence
  Synthetic nucleic acid molecule
agcatggtgattaagagtgagga

SEQ ID NO: 6389 - DNA, 23 bp, Artificial Sequence
  Synthetic nucleic acid molecule
agtagtctctggctgagtgaggt

SEQ ID NO: 6390 - DNA, 23 bp, Artificial Sequence
  Synthetic nucleic acid molecule
agcattgtttctcagagtgaggt

SEQ ID NO: 6391 - DNA, 23 bp, Artificial Sequence
  Synthetic nucleic acid molecule
agcaaggttaggctgagtgaggg

SEQ ID NO: 6392 - DNA, 24 bp, Artificial Sequence
  Synthetic nucleic acid molecule
agcagtcttccaccagagtgaggc

SEQ ID NO: 6393 - DNA, 23 bp, Artificial Sequence
  Synthetic nucleic acid molecule
agcattgtttgagtgagtgaggt

SEQ ID NO: 6394 - DNA, 24 bp, Artificial Sequence
  Synthetic nucleic acid molecule
agcagcgtccgcagcaagttagga

SEQ ID NO: 6395 - DNA, 24 bp, Artificial Sequence
  Synthetic nucleic acid molecule
agcagcgtcactacagaggcagga

SEQ ID NO: 6396 - DNA, 24 bp, Artificial Sequence
  Synthetic nucleic acid molecule
ggcagcgtctctctggggtgagga

SEQ ID NO: 6397 - DNA, 23 bp, Artificial Sequence
  Synthetic nucleic acid molecule
agcagagtcttgaagagtgagta

SEQ ID NO: 6398 - DNA, 23 bp, Artificial Sequence
  Synthetic nucleic acid molecule
agcagcatctatgccagtgagga

SEQ ID NO: 6399 - DNA, 23 bp, Artificial Sequence
  Synthetic nucleic acid molecule
agcagagtctggcagagagagga

SEQ ID NO: 6400 - DNA, 23 bp, Artificial Sequence
  Synthetic nucleic acid molecule
agcagtgtccctcagagtgtgga

SEQ ID NO: 6401 - DNA, 23 bp, Artificial Sequence
  Synthetic nucleic acid molecule
agcagcatcttggagtgtgagga

SEQ ID NO: 6402 - DNA, 23 bp, Artificial Sequence
  Synthetic nucleic acid molecule
agctgcgtcttctggagggagga

SEQ ID NO: 6403 - DNA, 24 bp, Artificial Sequence
  Synthetic nucleic acid molecule
agcagcttcagaagagaatgagga

SEQ ID NO: 6404 - DNA, 23 bp, Artificial Sequence
  Synthetic nucleic acid molecule
agcagggtcgaggggagggagga

SEQ ID NO: 6405 - DNA, 23 bp, Artificial Sequence
  Synthetic nucleic acid molecule
agcagggtctggtgcagtgagga

SEQ ID NO: 6406 - DNA, 23 bp, Artificial Sequence
  Synthetic nucleic acid molecule
agcagcatccatgtcagtgagga

SEQ ID NO: 6407 - DNA, 23 bp, Artificial Sequence
  Synthetic nucleic acid molecule
agcagagtcccaaggggtgagga

SEQ ID NO: 6408 - DNA, 23 bp, Artificial Sequence
  Synthetic nucleic acid molecule
agcagcctctgaacaagtgagga

SEQ ID NO: 6409 - DNA, 23 bp, Artificial Sequence
  Synthetic nucleic acid molecule
agcagcctctaggtaagtgagga

SEQ ID NO: 6410 - DNA, 24 bp, Artificial Sequence
  Synthetic nucleic acid molecule
agcagcttcagatttgagttagga

SEQ ID NO: 6411 - DNA, 23 bp, Artificial Sequence
  Synthetic nucleic acid molecule
agcagcctcacaggcagtgagga

SEQ ID NO: 6412 - DNA, 23 bp, Artificial Sequence
  Synthetic nucleic acid molecule
agcagcatcaacaccagtgagga

SEQ ID NO: 6413 - DNA, 24 bp, Artificial Sequence
  Synthetic nucleic acid molecule
agcagcgtgtcagctgtgtgagga

SEQ ID NO: 6414 - DNA, 23 bp, Artificial Sequence
  Synthetic nucleic acid molecule
agcagcatctatgccagtgagga

SEQ ID NO: 6415 - DNA, 24 bp, Artificial Sequence
  Synthetic nucleic acid molecule
agcagcatcaataataagtgagga

SEQ ID NO: 6416 - DNA, 23 bp, Artificial Sequence
  Synthetic nucleic acid molecule
agcagagtcacccagtgtgagga

SEQ ID NO: 6417 - DNA, 24 bp, Artificial Sequence
  Synthetic nucleic acid molecule
ggcagcgtctgggaggagttagga

SEQ ID NO: 6418 - DNA, 23 bp, Artificial Sequence
  Synthetic nucleic acid molecule
agcagcgccatcttgagcgagga

SEQ ID NO: 6419 - DNA, 23 bp, Artificial Sequence
  Synthetic nucleic acid molecule
agctgcgtcgtgagaagtgagga

SEQ ID NO: 6420 - DNA, 23 bp, Artificial Sequence
  Synthetic nucleic acid molecule
agcagggtcacacagggtgagga

SEQ ID NO: 6421 - DNA, 24 bp, Artificial Sequence
  Synthetic nucleic acid molecule
agcagagtcagagaggagagagga

SEQ ID NO: 6422 - DNA, 24 bp, Artificial Sequence
  Synthetic nucleic acid molecule
agcagagtcactgaccagtgagga

SEQ ID NO: 6423 - DNA, 23 bp, Artificial Sequence
  Synthetic nucleic acid molecule
agcagtgtctcccagagtgtgga

SEQ ID NO: 6424 - DNA, 24 bp, Artificial Sequence
  Synthetic nucleic acid molecule
agcagtgtctgagtagagtgtgga

SEQ ID NO: 6425 - DNA, 23 bp, Artificial Sequence
  Synthetic nucleic acid molecule
agcagcatcccggggagtgaaga

SEQ ID NO: 6426 - DNA, 24 bp, Artificial Sequence
  Synthetic nucleic acid molecule
aacagcgtcaaggcagagtgaaga

SEQ ID NO: 6427 - DNA, 23 bp, Artificial Sequence
  Synthetic nucleic acid molecule
agcagcgccatcttgagcgagga

SEQ ID NO: 6428 - DNA, 23 bp, Artificial Sequence
  Synthetic nucleic acid molecule
agcagcgccatcttgagcgagga

SEQ ID NO: 6429 - DNA, 23 bp, Artificial Sequence
  Synthetic nucleic acid molecule
agcagcgccatcttgagcgagga

SEQ ID NO: 6430 - DNA, 23 bp, Artificial Sequence
  Synthetic nucleic acid molecule
agcagcgccatcttgagcgagga

SEQ ID NO: 6431 - DNA, 23 bp, Artificial Sequence
  Synthetic nucleic acid molecule
agcagcgccatcttgagcgagga

SEQ ID NO: 6432 - DNA, 23 bp, Artificial Sequence
  Synthetic nucleic acid molecule
agcagcgccatcttgagcgagga

SEQ ID NO: 6433 - DNA, 23 bp, Artificial Sequence
  Synthetic nucleic acid molecule
agcagcgccatcttgagcgagga

SEQ ID NO: 6434 - DNA, 23 bp, Artificial Sequence
  Synthetic nucleic acid molecule
agcagcgccatcttgagcgagga

SEQ ID NO: 6435 - DNA, 23 bp, Artificial Sequence
  Synthetic nucleic acid molecule
agcagcatccatgtcagtgagga

SEQ ID NO: 6436 - DNA, 24 bp, Artificial Sequence
  Synthetic nucleic acid molecule
agcagagtcagggaggagtgaaga

SEQ ID NO: 6437 - DNA, 24 bp, Artificial Sequence
  Synthetic nucleic acid molecule
agcagcctcatggtcaagtgagga

SEQ ID NO: 6438 - DNA, 24 bp, Artificial Sequence
  Synthetic nucleic acid molecule
agcagcatcgtgagtgagtgtgga

SEQ ID NO: 6439 - DNA, 24 bp, Artificial Sequence
  Synthetic nucleic acid molecule
agcagtgtctagcacgaatgagga

SEQ ID NO: 6440 - DNA, 24 bp, Artificial Sequence
  Synthetic nucleic acid molecule
agcagagtcacagaagagagagga

SEQ ID NO: 6441 - DNA, 23 bp, Artificial Sequence
  Synthetic nucleic acid molecule
agcagcgtggttaagagtcagga

SEQ ID NO: 6442 - DNA, 24 bp, Artificial Sequence
  Synthetic nucleic acid molecule
accagcgtctggtgagagtgggga

SEQ ID NO: 6443 - DNA, 23 bp, Artificial Sequence
  Synthetic nucleic acid molecule
agcagtgtcttgctgagagagga

SEQ ID NO: 6444 - DNA, 24 bp, Artificial Sequence
  Synthetic nucleic acid molecule
agcagcgacctgggcgagtgagaa

SEQ ID NO: 6445 - DNA, 24 bp, Artificial Sequence
  Synthetic nucleic acid molecule
agcagtgtctgccgtgagtgggga

SEQ ID NO: 6446 - DNA, 23 bp, Artificial Sequence
  Synthetic nucleic acid molecule
agcagcgtaatacacagtgagga

SEQ ID NO: 6447 - DNA, 24 bp, Artificial Sequence
  Synthetic nucleic acid molecule
agcagcctctagagaaagtgagga

SEQ ID NO: 6448 - DNA, 24 bp, Artificial Sequence
  Synthetic nucleic acid molecule
agcagagtcacgggtgtgtgagga

SEQ ID NO: 6449 - DNA, 23 bp, Artificial Sequence
  Synthetic nucleic acid molecule
tgcagcgtcatcaagagtgtgga

SEQ ID NO: 6450 - DNA, 24 bp, Artificial Sequence
  Synthetic nucleic acid molecule
agcagggaccaggtggagtgagga

SEQ ID NO: 6451 - DNA, 24 bp, Artificial Sequence
  Synthetic nucleic acid molecule
agcaggctctaaaatgagtgagga

SEQ ID NO: 6452 - DNA, 23 bp, Artificial Sequence
  Synthetic nucleic acid molecule
agcagcctaggaatgagtgagga

SEQ ID NO: 6453 - DNA, 24 bp, Artificial Sequence
  Synthetic nucleic acid molecule
agcatcctccaggaggagtgagga

SEQ ID NO: 6454 - DNA, 24 bp, Artificial Sequence
  Synthetic nucleic acid molecule
agcagagtactcagtgagtgagga

SEQ ID NO: 6455 - DNA, 23 bp, Artificial Sequence
  Synthetic nucleic acid molecule
agcagggtagaagagagtgagga

SEQ ID NO: 6456 - DNA, 24 bp, Artificial Sequence
  Synthetic nucleic acid molecule
agcagagacctgagggagtgagga

SEQ ID NO: 6457 - DNA, 23 bp, Artificial Sequence
  Synthetic nucleic acid molecule
agcagagtgggcaagagtgagga

SEQ ID NO: 6458 - DNA, 24 bp, Artificial Sequence
  Synthetic nucleic acid molecule
agctgcctcggtggggagtgagga

SEQ ID NO: 6459 - DNA, 24 bp, Artificial Sequence
  Synthetic nucleic acid molecule
aggagggtcctggatgagtgagga

SEQ ID NO: 6460 - DNA, 24 bp, Artificial Sequence
  Synthetic nucleic acid molecule
agcagactccttgatgagtgagga

SEQ ID NO: 6461 - DNA, 23 bp, Artificial Sequence
  Synthetic nucleic acid molecule
agcagagtatttgggagtgagga

SEQ ID NO: 6462 - DNA, 23 bp, Artificial Sequence
  Synthetic nucleic acid molecule
agcagagttgccaggagtgagga

SEQ ID NO: 6463 - DNA, 24 bp, Artificial Sequence
  Synthetic nucleic acid molecule
agcagcaccaaaatggagtgagga

SEQ ID NO: 6464 - DNA, 24 bp, Artificial Sequence
  Synthetic nucleic acid molecule
agcaggatcaggttagagtgagga

SEQ ID NO: 6465 - DNA, 24 bp, Artificial Sequence
  Synthetic nucleic acid molecule
tgcagcatccttcaggagtgagga

SEQ ID NO: 6466 - DNA, 23 bp, Artificial Sequence
  Synthetic nucleic acid molecule
agcagagtgtggtggagtgagga

SEQ ID NO: 6467 - DNA, 23 bp, Artificial Sequence
  Synthetic nucleic acid molecule
agcagtgcctaccagagtgagga

SEQ ID NO: 6468 - DNA, 23 bp, Artificial Sequence
  Synthetic nucleic acid molecule
agcagagtacccatgagtgagga

SEQ ID NO: 6469 - DNA, 24 bp, Artificial Sequence
  Synthetic nucleic acid molecule
agcagagtgaaaggagagtgagga

SEQ ID NO: 6470 - DNA, 24 bp, Artificial Sequence
  Synthetic nucleic acid molecule
agcaggatcaagaaagagtgagga

SEQ ID NO: 6471 - DNA, 24 bp, Artificial Sequence
  Synthetic nucleic acid molecule
agcagcttgtgtcatgagtgagga

SEQ ID NO: 6472 - DNA, 24 bp, Artificial Sequence
  Synthetic nucleic acid molecule
agcagagtaggttgtgagtgagga

SEQ ID NO: 6473 - DNA, 24 bp, Artificial Sequence
  Synthetic nucleic acid molecule
agcagcgtctgcagtttgtgggga

SEQ ID NO: 6474 - DNA, 24 bp, Artificial Sequence
  Synthetic nucleic acid molecule
agcagcgtcaggggattgtgggga

SEQ ID NO: 6475 - DNA, 23 bp, Artificial Sequence
  Synthetic nucleic acid molecule
agcagcgtccaagagagttacaa

SEQ ID NO: 6476 - DNA, 23 bp, Artificial Sequence
  Synthetic nucleic acid molecule
agcagcgtcaaagtttgagagga

SEQ ID NO: 6477 - DNA, 24 bp, Artificial Sequence
  Synthetic nucleic acid molecule
agcagcgtcaggcttcagtgtgaa

SEQ ID NO: 6478 - DNA, 24 bp, Artificial Sequence
  Synthetic nucleic acid molecule
agcagcgtcaggcttcagtgtgaa

SEQ ID NO: 6479 - DNA, 23 bp, Artificial Sequence
  Synthetic nucleic acid molecule
agcagcgtctttttgagagaagg

SEQ ID NO: 6480 - DNA, 23 bp, Artificial Sequence
  Synthetic nucleic acid molecule
agcagcgtcggggagagttgggg

SEQ ID NO: 6481 - DNA, 23 bp, Artificial Sequence
  Synthetic nucleic acid molecule
agcagcgtctccaggaacgtgga

SEQ ID NO: 6482 - DNA, 24 bp, Artificial Sequence
  Synthetic nucleic acid molecule
agcagcgtccttggggagtttggg

SEQ ID NO: 6483 - DNA, 23 bp, Artificial Sequence
  Synthetic nucleic acid molecule
agcagcgtcgtcacaggggagga

SEQ ID NO: 6484 - DNA, 23 bp, Artificial Sequence
  Synthetic nucleic acid molecule
agcagcgtccaaaaggctgaggg

SEQ ID NO: 6485 - DNA, 23 bp, Artificial Sequence
  Synthetic nucleic acid molecule
agcagcgtccgtcgcagtggggc

SEQ ID NO: 6486 - DNA, 24 bp, Artificial Sequence
  Synthetic nucleic acid molecule
agcagcgtccgcactgagggggca

SEQ ID NO: 6487 - DNA, 23 bp, Artificial Sequence
  Synthetic nucleic acid molecule
agcagcgtctctgcgggagaggc

SEQ ID NO: 6488 - DNA, 23 bp, Artificial Sequence
  Synthetic nucleic acid molecule
agcagcgtcatcttgagtggagc

SEQ ID NO: 6489 - DNA, 23 bp, Artificial Sequence
  Synthetic nucleic acid molecule
agcagcgtcagcgacagagaggc

SEQ ID NO: 6490 - DNA, 23 bp, Artificial Sequence
  Synthetic nucleic acid molecule
agcagcgtctgtatgtgtcagaa

SEQ ID NO: 6491 - DNA, 24 bp, Artificial Sequence
  Synthetic nucleic acid molecule
agcagcgtcattagggcatgagca

SEQ ID NO: 6492 - DNA, 24 bp, Artificial Sequence
  Synthetic nucleic acid molecule
agcagcgtcgatggaaagggaaga

SEQ ID NO: 6493 - DNA, 23 bp, Artificial Sequence
  Synthetic nucleic acid molecule
agcagcgtcaggaagagttgtga

SEQ ID NO: 6494 - DNA, 24 bp, Artificial Sequence
  Synthetic nucleic acid molecule
agcagcgtctaccgtgagtgctca

SEQ ID NO: 6495 - DNA, 23 bp, Artificial Sequence
  Synthetic nucleic acid molecule
agcagcgtcagggtttgagagga

SEQ ID NO: 6496 - DNA, 24 bp, Artificial Sequence
  Synthetic nucleic acid molecule
agcagcgtcatgagtgtgtaatga

SEQ ID NO: 6497 - DNA, 24 bp, Artificial Sequence
  Synthetic nucleic acid molecule
agcagcgtctctttagagtgggtt

SEQ ID NO: 6498 - DNA, 23 bp, Artificial Sequence
  Synthetic nucleic acid molecule
agcagcgtcctgtggaggcagaa

SEQ ID NO: 6499 - DNA, 24 bp, Artificial Sequence
  Synthetic nucleic acid molecule
agcagcgtcaggcttcagtgtgaa

SEQ ID NO: 6500 - DNA, 24 bp, Artificial Sequence
  Synthetic nucleic acid molecule
agcagcgtcaggcttcagtgtgaa

SEQ ID NO: 6501 - DNA, 24 bp, Artificial Sequence
  Synthetic nucleic acid molecule
agcagcgtcaggcttcagtgtgaa

SEQ ID NO: 6502 - DNA, 24 bp, Artificial Sequence
  Synthetic nucleic acid molecule
agcagcgtcaggcttcagtgtgaa

SEQ ID NO: 6503 - DNA, 24 bp, Artificial Sequence
  Synthetic nucleic acid molecule
agcagcgtcaggcttcagtgtgaa

SEQ ID NO: 6504 - DNA, 24 bp, Artificial Sequence
  Synthetic nucleic acid molecule
agcagcgtcaggcttcagtgtgaa

SEQ ID NO: 6505 - DNA, 24 bp, Artificial Sequence
  Synthetic nucleic acid molecule
agcagcgtcaggcttcagtgtgaa

SEQ ID NO: 6506 - DNA, 23 bp, Artificial Sequence
  Synthetic nucleic acid molecule
agcagcgtcagggtttgagagga

SEQ ID NO: 6507 - DNA, 24 bp, Artificial Sequence
  Synthetic nucleic acid molecule
agcagcgtcacactctactgaggt

SEQ ID NO: 6508 - DNA, 24 bp, Artificial Sequence
  Synthetic nucleic acid molecule
agcagcgtcacatgccagcgaggt

SEQ ID NO: 6509 - DNA, 24 bp, Artificial Sequence
  Synthetic nucleic acid molecule
agcagcgtccatggtgacagaggt

SEQ ID NO: 6510 - DNA, 24 bp, Artificial Sequence
  Synthetic nucleic acid molecule
agcagcgtcttccctgagagagct

SEQ ID NO: 6511 - DNA, 23 bp, Artificial Sequence
  Synthetic nucleic acid molecule
agcagcgtccaggagaggaaggc

SEQ ID NO: 6512 - DNA, 23 bp, Artificial Sequence
  Synthetic nucleic acid molecule
agcagcgtcatacaggctgaggt

SEQ ID NO: 6513 - DNA, 23 bp, Artificial Sequence
  Synthetic nucleic acid molecule
agcagcgtctgcatgaaggaggt

SEQ ID NO: 6514 - DNA, 23 bp, Artificial Sequence
  Synthetic nucleic acid molecule
agcagcgtcccagtgagcgatgg

SEQ ID NO: 6515 - DNA, 23 bp, Artificial Sequence
  Synthetic nucleic acid molecule
agcagcgtcttgcaaagggagaa

SEQ ID NO: 6516 - DNA, 23 bp, Artificial Sequence
  Synthetic nucleic acid molecule
agcagcgtcagggtttgagagga

SEQ ID NO: 6517 - DNA, 23 bp, Artificial Sequence
  Synthetic nucleic acid molecule
agcagcgtccacgtgtgtgcggt

SEQ ID NO: 6518 - DNA, 24 bp, Artificial Sequence
  Synthetic nucleic acid molecule
agcagcgtcagcctctagagggga

SEQ ID NO: 6519 - DNA, 23 bp, Artificial Sequence
  Synthetic nucleic acid molecule
agcagcgtccgcaggaggtaggg

SEQ ID NO: 6520 - DNA, 23 bp, Artificial Sequence
  Synthetic nucleic acid molecule
agcagcgtccaagagtgttacga

SEQ ID NO: 6521 - DNA, 23 bp, Artificial Sequence
  Synthetic nucleic acid molecule
agcagcgtcctagcctgtgaggg

SEQ ID NO: 6522 - DNA, 24 bp, Artificial Sequence
  Synthetic nucleic acid molecule
agcagcgtcctcctggagggagag

SEQ ID NO: 6523 - DNA, 24 bp, Artificial Sequence
  Synthetic nucleic acid molecule
agcagcgtcagggaggaggggaga

SEQ ID NO: 6524 - DNA, 24 bp, Artificial Sequence
  Synthetic nucleic acid molecule
agcagcgtccccccgcagtgatgg

SEQ ID NO: 6525 - DNA, 24 bp, Artificial Sequence
  Synthetic nucleic acid molecule
agcagcgtctcctgagagagaagg

SEQ ID NO: 6526 - DNA, 24 bp, Artificial Sequence
  Synthetic nucleic acid molecule
agcagcgtctgtcctgagtccaga

SEQ ID NO: 6527 - DNA, 24 bp, Artificial Sequence
  Synthetic nucleic acid molecule
agcagcgtcaaggattagagagta

SEQ ID NO: 6528 - DNA, 24 bp, Artificial Sequence
  Synthetic nucleic acid molecule
agcagcgtctcctgagagagaagg

SEQ ID NO: 6529 - DNA, 23 bp, Artificial Sequence
  Synthetic nucleic acid molecule
agtagcgtcctaatgagtgtgaa

SEQ ID NO: 6530 - DNA, 24 bp, Artificial Sequence
  Synthetic nucleic acid molecule
agcagcttctccatggagtgagac

SEQ ID NO: 6531 - DNA, 23 bp, Artificial Sequence
  Synthetic nucleic acid molecule
agcagggtcggggagagggaggg

SEQ ID NO: 6532 - DNA, 24 bp, Artificial Sequence
  Synthetic nucleic acid molecule
agcagcatccagactcagtgaggt

SEQ ID NO: 6533 - DNA, 24 bp, Artificial Sequence
  Synthetic nucleic acid molecule
agcagggtcagctaagagggaggc

SEQ ID NO: 6534 - DNA, 23 bp, Artificial Sequence
  Synthetic nucleic acid molecule
agcagcggcagcgagagtgatgt

SEQ ID NO: 6535 - DNA, 23 bp, Artificial Sequence
  Synthetic nucleic acid molecule
ggcagcgtctgacggagtgagtg

SEQ ID NO: 6536 - DNA, 24 bp, Artificial Sequence
  Synthetic nucleic acid molecule
agcagtgtcaggtaggagagaggc

SEQ ID NO: 6537 - DNA, 24 bp, Artificial Sequence
  Synthetic nucleic acid molecule
agcagggtctgagtggagtaaggt

SEQ ID NO: 6538 - DNA, 24 bp, Artificial Sequence
  Synthetic nucleic acid molecule
agcagtgtcagctggtagtgagaa

SEQ ID NO: 6539 - DNA, 23 bp, Artificial Sequence
  Synthetic nucleic acid molecule
agcaccgtctgggggagggaaga

SEQ ID NO: 6540 - DNA, 24 bp, Artificial Sequence
  Synthetic nucleic acid molecule
agcagcatcagcatggagggaggc

SEQ ID NO: 6541 - DNA, 24 bp, Artificial Sequence
  Synthetic nucleic acid molecule
agcagcctcggtcaagagtgagag

SEQ ID NO: 6542 - DNA, 23 bp, Artificial Sequence
  Synthetic nucleic acid molecule
ggcagcgtcaataaaagtgaggg

SEQ ID NO: 6543 - DNA, 23 bp, Artificial Sequence
  Synthetic nucleic acid molecule
agcaacgtcggcagcagtgggga

SEQ ID NO: 6544 - DNA, 24 bp, Artificial Sequence
  Synthetic nucleic acid molecule
agcaacgtcagcaaagtctgagga

SEQ ID NO: 6545 - DNA, 24 bp, Artificial Sequence
  Synthetic nucleic acid molecule
agcagggtcagtgtctagtgagaa

SEQ ID NO: 6546 - DNA, 24 bp, Artificial Sequence
  Synthetic nucleic acid molecule
agcagggtcaggatggagtggggt

SEQ ID NO: 6547 - DNA, 24 bp, Artificial Sequence
  Synthetic nucleic acid molecule
agcagtgtcagtgaacagtgaggt

SEQ ID NO: 6548 - DNA, 24 bp, Artificial Sequence
  Synthetic nucleic acid molecule
agcagggtcagtgcctagtgaggg

SEQ ID NO: 6549 - DNA, 24 bp, Artificial Sequence
  Synthetic nucleic acid molecule
agcagcgtacggactgagtgagcc

SEQ ID NO: 6550 - DNA, 24 bp, Artificial Sequence
  Synthetic nucleic acid molecule
agcagcttccccagtaagtgagaa

SEQ ID NO: 6551 - DNA, 23 bp, Artificial Sequence
  Synthetic nucleic acid molecule
agcagcggcacctcgagagagaa

SEQ ID NO: 6552 - DNA, 23 bp, Artificial Sequence
  Synthetic nucleic acid molecule
agcagtgtcctcaccagtaagga

SEQ ID NO: 6553 - DNA, 23 bp, Artificial Sequence
  Synthetic nucleic acid molecule
agcagggtctgttagagtgagtg

SEQ ID NO: 6554 - DNA, 23 bp, Artificial Sequence
  Synthetic nucleic acid molecule
agcagcttcacctggagggaggg

SEQ ID NO: 6555 - DNA, 24 bp, Artificial Sequence
  Synthetic nucleic acid molecule
agcaccgtcatctaagggtgaggc

SEQ ID NO: 6556 - DNA, 23 bp, Artificial Sequence
  Synthetic nucleic acid molecule
agcatcgtcctgtggagcgaggg

SEQ ID NO: 6557 - DNA, 24 bp, Artificial Sequence
  Synthetic nucleic acid molecule
agcagggtccttactcagtgaggt

SEQ ID NO: 6558 - DNA, 23 bp, Artificial Sequence
  Synthetic nucleic acid molecule
agcagagtctgagagtgtgaggt

SEQ ID NO: 6559 - DNA, 24 bp, Artificial Sequence
  Synthetic nucleic acid molecule
agcagcgtgcagtgacagtgaggc

SEQ ID NO: 6560 - DNA, 24 bp, Artificial Sequence
  Synthetic nucleic acid molecule
agcaccgtcattggagagggagaa

SEQ ID NO: 6561 - DNA, 23 bp, Artificial Sequence
  Synthetic nucleic acid molecule
agcagcttcacctggagggaggg

SEQ ID NO: 6562 - DNA, 24 bp, Artificial Sequence
  Synthetic nucleic acid molecule
agcagagtcgctgcagagtgagcc

SEQ ID NO: 6563 - DNA, 23 bp, Artificial Sequence
  Synthetic nucleic acid molecule
agcagcttcacctggagggaggg

SEQ ID NO: 6564 - DNA, 23 bp, Artificial Sequence
  Synthetic nucleic acid molecule
agcagcttcacctggagggaggg

SEQ ID NO: 6565 - DNA, 23 bp, Artificial Sequence
  Synthetic nucleic acid molecule
agcagcttcacctggagggaggg

SEQ ID NO: 6566 - DNA, 23 bp, Artificial Sequence
  Synthetic nucleic acid molecule
agcagcttcacctggagggaggg

SEQ ID NO: 6567 - DNA, 23 bp, Artificial Sequence
  Synthetic nucleic acid molecule
agcagcttcacctggagggaggg

SEQ ID NO: 6568 - DNA, 23 bp, Artificial Sequence
  Synthetic nucleic acid molecule
agcagcttcacctggagggaggg

SEQ ID NO: 6569 - DNA, 23 bp, Artificial Sequence
  Synthetic nucleic acid molecule
agcagagtccttgggagggaggg

SEQ ID NO: 6570 - DNA, 23 bp, Artificial Sequence
  Synthetic nucleic acid molecule
agcagcttcacctggagggaggg

SEQ ID NO: 6571 - DNA, 24 bp, Artificial Sequence
  Synthetic nucleic acid molecule
agcagcgtatgcatacagtgaggg

SEQ ID NO: 6572 - DNA, 24 bp, Artificial Sequence
  Synthetic nucleic acid molecule
agcagtgtcaggctggtgtgagaa

SEQ ID NO: 6573 - DNA, 24 bp, Artificial Sequence
  Synthetic nucleic acid molecule
agcagagtcggcgtctagtgaggg

SEQ ID NO: 6574 - DNA, 24 bp, Artificial Sequence
  Synthetic nucleic acid molecule
agcagcgtgggccgggagggaggt

SEQ ID NO: 6575 - DNA, 23 bp, Artificial Sequence
  Synthetic nucleic acid molecule
ggcagcgtccgattcagtgaggg

SEQ ID NO: 6576 - DNA, 24 bp, Artificial Sequence
  Synthetic nucleic acid molecule
agcagcttcactgaagagggaggc

SEQ ID NO: 6577 - DNA, 23 bp, Artificial Sequence
  Synthetic nucleic acid molecule
atcagcgtctctgggagtggggc

SEQ ID NO: 6578 - DNA, 24 bp, Artificial Sequence
  Synthetic nucleic acid molecule
agcagcggcaggcgagagtgacaa

SEQ ID NO: 6579 - DNA, 23 bp, Artificial Sequence
  Synthetic nucleic acid molecule
agcagcttcaacgtgagtgatgt

SEQ ID NO: 6580 - DNA, 23 bp, Artificial Sequence
  Synthetic nucleic acid molecule
agcagcttcctggggagtgagtt

SEQ ID NO: 6581 - DNA, 23 bp, Artificial Sequence
  Synthetic nucleic acid molecule
agcagcatctcgtggagggaggc

SEQ ID NO: 6582 - DNA, 23 bp, Artificial Sequence
  Synthetic nucleic acid molecule
agcagagtcttcaggagagaggc

SEQ ID NO: 6583 - DNA, 24 bp, Artificial Sequence
  Synthetic nucleic acid molecule
agcagggtcaagttccagtgaggg

SEQ ID NO: 6584 - DNA, 24 bp, Artificial Sequence
  Synthetic nucleic acid molecule
agcagagtcagtcttgagtgagtt

SEQ ID NO: 6585 - DNA, 24 bp, Artificial Sequence
  Synthetic nucleic acid molecule
agcagagtcagacttgagtgagtt

SEQ ID NO: 6586 - DNA, 23 bp, Artificial Sequence
  Synthetic nucleic acid molecule
tgcagcgtccagatgagggaggt

SEQ ID NO: 6587 - DNA, 23 bp, Artificial Sequence
  Synthetic nucleic acid molecule
agcatcgtcagaatgggtgaggg

SEQ ID NO: 6588 - DNA, 24 bp, Artificial Sequence
  Synthetic nucleic acid molecule
agcagtgtccagctccagtgaggc

SEQ ID NO: 6589 - DNA, 24 bp, Artificial Sequence
  Synthetic nucleic acid molecule
agcagcttctaaaaggagagaggt

SEQ ID NO: 6590 - DNA, 24 bp, Artificial Sequence
  Synthetic nucleic acid molecule
agcagggtccatgaggagtgagcc

SEQ ID NO: 6591 - DNA, 24 bp, Artificial Sequence
  Synthetic nucleic acid molecule
agcagtgtcaccacagagtgaagg

SEQ ID NO: 6592 - DNA, 24 bp, Artificial Sequence
  Synthetic nucleic acid molecule
agcagggtcaggttttagtgaggg

SEQ ID NO: 6593 - DNA, 24 bp, Artificial Sequence
  Synthetic nucleic acid molecule
agcagcatcaatgtctagtgaggg

SEQ ID NO: 6594 - DNA, 24 bp, Artificial Sequence
  Synthetic nucleic acid molecule
agcagtgtcccgcacgaggaagga

SEQ ID NO: 6595 - DNA, 24 bp, Artificial Sequence
  Synthetic nucleic acid molecule
agcagcttcttgtgagagagaggt

SEQ ID NO: 6596 - DNA, 24 bp, Artificial Sequence
  Synthetic nucleic acid molecule
agcagagtcctaagcgggtgaggg

SEQ ID NO: 6597 - DNA, 23 bp, Artificial Sequence
  Synthetic nucleic acid molecule
agcagtgtcaagtagagtgaagg

SEQ ID NO: 6598 - DNA, 24 bp, Artificial Sequence
  Synthetic nucleic acid molecule
agcatcgtcaagttctggtgagga

SEQ ID NO: 6599 - DNA, 24 bp, Artificial Sequence
  Synthetic nucleic acid molecule
agcagggtccctgctgagagaggg

SEQ ID NO: 6600 - DNA, 24 bp, Artificial Sequence
  Synthetic nucleic acid molecule
agcagagtcaagtcagagagaggc

SEQ ID NO: 6601 - DNA, 23 bp, Artificial Sequence
  Synthetic nucleic acid molecule
agcagcggctgatggactgaggc

SEQ ID NO: 6602 - DNA, 24 bp, Artificial Sequence
  Synthetic nucleic acid molecule
agcagagtccagtgggtgtgaggc

SEQ ID NO: 6603 - DNA, 23 bp, Artificial Sequence
  Synthetic nucleic acid molecule
agcagcggctgatggactgaggc

SEQ ID NO: 6604 - DNA, 24 bp, Artificial Sequence
  Synthetic nucleic acid molecule
agcagcggcagccgagagagaggg

SEQ ID NO: 6605 - DNA, 23 bp, Artificial Sequence
  Synthetic nucleic acid molecule
agcagcggctgatggactgaggc

SEQ ID NO: 6606 - DNA, 23 bp, Artificial Sequence
  Synthetic nucleic acid molecule
agcagcggctgatggactgaggc

SEQ ID NO: 6607 - DNA, 23 bp, Artificial Sequence
  Synthetic nucleic acid molecule
agcagcggctgatggactgaggc

SEQ ID NO: 6608 - DNA, 23 bp, Artificial Sequence
  Synthetic nucleic acid molecule
agcagcggctgatggactgaggc

SEQ ID NO: 6609 - DNA, 23 bp, Artificial Sequence
  Synthetic nucleic acid molecule
agcagcggctgatggactgaggc

SEQ ID NO: 6610 - DNA, 24 bp, Artificial Sequence
  Synthetic nucleic acid molecule
agcagcggcagccgagagagaggg

SEQ ID NO: 6611 - DNA, 23 bp, Artificial Sequence
  Synthetic nucleic acid molecule
agcagcggctgatggactgaggc

SEQ ID NO: 6612 - DNA, 23 bp, Artificial Sequence
  Synthetic nucleic acid molecule
tgcagcgtcttgtttagtgaggc

SEQ ID NO: 6613 - DNA, 24 bp, Artificial Sequence
  Synthetic nucleic acid molecule
agcagtgtcaggctggtgtgagaa

SEQ ID NO: 6614 - DNA, 24 bp, Artificial Sequence
  Synthetic nucleic acid molecule
agcagcgtagagtgggaatgaggg

SEQ ID NO: 6615 - DNA, 24 bp, Artificial Sequence
  Synthetic nucleic acid molecule
agcatcgtcacaggagggtgaggt

SEQ ID NO: 6616 - DNA, 23 bp, Artificial Sequence
  Synthetic nucleic acid molecule
agcagcggcacccagaatgaggg

SEQ ID NO: 6617 - DNA, 24 bp, Artificial Sequence
  Synthetic nucleic acid molecule
agcagcgttatttcagagtgtggt

SEQ ID NO: 6618 - DNA, 24 bp, Artificial Sequence
  Synthetic nucleic acid molecule
agcagagtcgctccagagtgagcc

SEQ ID NO: 6619 - DNA, 24 bp, Artificial Sequence
  Synthetic nucleic acid molecule
agcagtgtcatctttgagtgggaa

SEQ ID NO: 6620 - DNA, 24 bp, Artificial Sequence
  Synthetic nucleic acid molecule
agcagcatctcctagcagtgaggg

SEQ ID NO: 6621 - DNA, 23 bp, Artificial Sequence
  Synthetic nucleic acid molecule
agcaacgtcagtgggactgaggg

SEQ ID NO: 6622 - DNA, 23 bp, Artificial Sequence
  Synthetic nucleic acid molecule
agcaccgtcatcttgagtgagct

SEQ ID NO: 6623 - DNA, 23 bp, Artificial Sequence
  Synthetic nucleic acid molecule
agcagggtcctgaggggagagga

SEQ ID NO: 6624 - DNA, 24 bp, Artificial Sequence
  Synthetic nucleic acid molecule
ggcagcgtcaggagagagtgatgt

SEQ ID NO: 6625 - DNA, 24 bp, Artificial Sequence
  Synthetic nucleic acid molecule
agcatcgtcggggaggagtgggaa

SEQ ID NO: 6626 - DNA, 24 bp, Artificial Sequence
  Synthetic nucleic acid molecule
agcagtgtctgtgctcagtgaggt

SEQ ID NO: 6627 - DNA, 24 bp, Artificial Sequence
  Synthetic nucleic acid molecule
agcagtgtcagtcctgagagagca

SEQ ID NO: 6628 - DNA, 24 bp, Artificial Sequence
  Synthetic nucleic acid molecule
agcagcgttgctttctagtgaggt

SEQ ID NO: 6629 - DNA, 24 bp, Artificial Sequence
  Synthetic nucleic acid molecule
agcagcggcgacagggagagaggg

SEQ ID NO: 6630 - DNA, 24 bp, Artificial Sequence
  Synthetic nucleic acid molecule
agcaccgtcctgaaacagtgagta

SEQ ID NO: 6631 - DNA, 24 bp, Artificial Sequence
  Synthetic nucleic acid molecule
agcagtgtctgctgggagggtgga

SEQ ID NO: 6632 - DNA, 24 bp, Artificial Sequence
  Synthetic nucleic acid molecule
agcagcgccctgtgggagggaggt

SEQ ID NO: 6633 - DNA, 23 bp, Artificial Sequence
  Synthetic nucleic acid molecule
agcagagtcagaaagagtaaggc

SEQ ID NO: 6634 - DNA, 24 bp, Artificial Sequence
  Synthetic nucleic acid molecule
agcagcttctctaaggagtggggg

SEQ ID NO: 6635 - DNA, 23 bp, Artificial Sequence
  Synthetic nucleic acid molecule
agcagcttcacctggagggaggg

SEQ ID NO: 6636 - DNA, 23 bp, Artificial Sequence
  Synthetic nucleic acid molecule
agcagcttcacctggagggaggg

SEQ ID NO: 6637 - DNA, 23 bp, Artificial Sequence
  Synthetic nucleic acid molecule
agcagcttcacctggagggaggg

SEQ ID NO: 6638 - DNA, 23 bp, Artificial Sequence
  Synthetic nucleic acid molecule
agcagcttcatctggagggaggg

SEQ ID NO: 6639 - DNA, 23 bp, Artificial Sequence
  Synthetic nucleic acid molecule
agcagcttcacctggagggaggg

SEQ ID NO: 6640 - DNA, 23 bp, Artificial Sequence
  Synthetic nucleic acid molecule
agcagcttcacctggagggaggg

SEQ ID NO: 6641 - DNA, 23 bp, Artificial Sequence
  Synthetic nucleic acid molecule
agcagcttcacctggagggaggg

SEQ ID NO: 6642 - DNA, 23 bp, Artificial Sequence
  Synthetic nucleic acid molecule
agcagcttcacctggagggaggg

SEQ ID NO: 6643 - DNA, 23 bp, Artificial Sequence
  Synthetic nucleic acid molecule
agcagcttcacctggagggaggg

SEQ ID NO: 6644 - DNA, 23 bp, Artificial Sequence
  Synthetic nucleic acid molecule
agcagcttcacctggagggaggg

SEQ ID NO: 6645 - DNA, 23 bp, Artificial Sequence
  Synthetic nucleic acid molecule
agcagcttcacctggagggaggg

SEQ ID NO: 6646 - DNA, 24 bp, Artificial Sequence
  Synthetic nucleic acid molecule
agcagcttcctgctccagtgaggg

SEQ ID NO: 6647 - DNA, 23 bp, Artificial Sequence
  Synthetic nucleic acid molecule
agcagcttcacctggagggaggg

SEQ ID NO: 6648 - DNA, 24 bp, Artificial Sequence
  Synthetic nucleic acid molecule
agcagagtcaagagggtgtgaggg

SEQ ID NO: 6649 - DNA, 24 bp, Artificial Sequence
  Synthetic nucleic acid molecule
agcagggtcctgaaggagggaggg

SEQ ID NO: 6650 - DNA, 24 bp, Artificial Sequence
  Synthetic nucleic acid molecule
agcagggtcagcccagagggaggc

SEQ ID NO: 6651 - DNA, 23 bp, Artificial Sequence
  Synthetic nucleic acid molecule
ggcagcgtcattttgagtggggg

SEQ ID NO: 6652 - DNA, 23 bp, Artificial Sequence
  Synthetic nucleic acid molecule
agcagcgtgtggcagagagaggg

SEQ ID NO: 6653 - DNA, 24 bp, Artificial Sequence
  Synthetic nucleic acid molecule
agcaccgtccccgaggtgggagga

SEQ ID NO: 6654 - DNA, 23 bp, Artificial Sequence
  Synthetic nucleic acid molecule
agcagcttcccatcgggtgaggg

SEQ ID NO: 6655 - DNA, 24 bp, Artificial Sequence
  Synthetic nucleic acid molecule
agcagcatctgtggacagtgaggt

SEQ ID NO: 6656 - DNA, 24 bp, Artificial Sequence
  Synthetic nucleic acid molecule
agcagcgtgctggatgagtgtggt

SEQ ID NO: 6657 - DNA, 24 bp, Artificial Sequence
  Synthetic nucleic acid molecule
agcagcggcaggcaccagtgaggg

SEQ ID NO: 6658 - DNA, 24 bp, Artificial Sequence
  Synthetic nucleic acid molecule
agcagggtcaggggtgagtggggt

SEQ ID NO: 6659 - DNA, 23 bp, Artificial Sequence
  Synthetic nucleic acid molecule
agcagcggcgaacagagcgggga

SEQ ID NO: 6660 - DNA, 24 bp, Artificial Sequence
  Synthetic nucleic acid molecule
agctgcgtctctgggaagtgaggg

SEQ ID NO: 6661 - DNA, 24 bp, Artificial Sequence
  Synthetic nucleic acid molecule
agcagggtcatgacagagagaggg

SEQ ID NO: 6662 - DNA, 23 bp, Artificial Sequence
  Synthetic nucleic acid molecule
agcagcatctggcagagtaaggg

SEQ ID NO: 6663 - DNA, 23 bp, Artificial Sequence
  Synthetic nucleic acid molecule
agcagtgtccacctgagttaggt

SEQ ID NO: 6664 - DNA, 23 bp, Artificial Sequence
  Synthetic nucleic acid molecule
agcagcgacggcgggtgtgaggc

SEQ ID NO: 6665 - DNA, 24 bp, Artificial Sequence
  Synthetic nucleic acid molecule
agcagggtcacactaaagtgaggc

SEQ ID NO: 6666 - DNA, 23 bp, Artificial Sequence
  Synthetic nucleic acid molecule
agctgtgtcatgacaagtgagga

SEQ ID NO: 6667 - DNA, 23 bp, Artificial Sequence
  Synthetic nucleic acid molecule
agctgggtcatgtgaagtgagga

SEQ ID NO: 6668 - DNA, 23 bp, Artificial Sequence
  Synthetic nucleic acid molecule
agctgggtcatgtgaagtgagga

SEQ ID NO: 6669 - DNA, 24 bp, Artificial Sequence
  Synthetic nucleic acid molecule
ggcagcggccggaaaaagtgagga

SEQ ID NO: 6670 - DNA, 23 bp, Artificial Sequence
  Synthetic nucleic acid molecule
agcatggtcaatgacagtgagga

SEQ ID NO: 6671 - DNA, 24 bp, Artificial Sequence
  Synthetic nucleic acid molecule
atcagcctcttgtaggagtgaggg

SEQ ID NO: 6672 - DNA, 23 bp, Artificial Sequence
  Synthetic nucleic acid molecule
agcatggtcatgaacagtgagga

SEQ ID NO: 6673 - DNA, 24 bp, Artificial Sequence
  Synthetic nucleic acid molecule
agcaggggcatgagagagtgaggt

SEQ ID NO: 6674 - DNA, 23 bp, Artificial Sequence
  Synthetic nucleic acid molecule
aacagcgtggcggagagtgaggg

SEQ ID NO: 6675 - DNA, 24 bp, Artificial Sequence
  Synthetic nucleic acid molecule
aacagagtccaggaagagtgaggt

SEQ ID NO: 6676 - DNA, 24 bp, Artificial Sequence
  Synthetic nucleic acid molecule
aacagcatcagctctgagtgaggc

SEQ ID NO: 6677 - DNA, 24 bp, Artificial Sequence
  Synthetic nucleic acid molecule
atcagtgtcagtgagcagtgagga

SEQ ID NO: 6678 - DNA, 23 bp, Artificial Sequence
  Synthetic nucleic acid molecule
agcagctgcatgatgagtgaggt

SEQ ID NO: 6679 - DNA, 23 bp, Artificial Sequence
  Synthetic nucleic acid molecule
agcagggttgatcagagggagga

SEQ ID NO: 6680 - DNA, 23 bp, Artificial Sequence
  Synthetic nucleic acid molecule
agcatagtccagattagtgagga

SEQ ID NO: 6681 - DNA, 23 bp, Artificial Sequence
  Synthetic nucleic acid molecule
agcagcaaccttaagagtgaggg

SEQ ID NO: 6682 - DNA, 23 bp, Artificial Sequence
  Synthetic nucleic acid molecule
agctacgtctaagggagagagga

SEQ ID NO: 6683 - DNA, 24 bp, Artificial Sequence
  Synthetic nucleic acid molecule
agcagcattggtcctgagtgaggt

SEQ ID NO: 6684 - DNA, 23 bp, Artificial Sequence
  Synthetic nucleic acid molecule
agcattgtcatgaagagggagga

SEQ ID NO: 6685 - DNA, 24 bp, Artificial Sequence
  Synthetic nucleic acid molecule
agcagcacctggcctgagtgaggg

SEQ ID NO: 6686 - DNA, 23 bp, Artificial Sequence
  Synthetic nucleic acid molecule
agcagggttgggcagagggagga

SEQ ID NO: 6687 - DNA, 24 bp, Artificial Sequence
  Synthetic nucleic acid molecule
agtagagtctgactaaagtgagga

SEQ ID NO: 6688 - DNA, 23 bp, Artificial Sequence
  Synthetic nucleic acid molecule
agcaacgtgagtgtgagcgagga

SEQ ID NO: 6689 - DNA, 23 bp, Artificial Sequence
  Synthetic nucleic acid molecule
agcaaggtcccactcagtgagga

SEQ ID NO: 6690 - DNA, 23 bp, Artificial Sequence
  Synthetic nucleic acid molecule
agcagccacaaggtgagtgaggg

SEQ ID NO: 6691 - DNA, 23 bp, Artificial Sequence
  Synthetic nucleic acid molecule
agcaatgtcagggaaagtgagga

SEQ ID NO: 6692 - DNA, 24 bp, Artificial Sequence
  Synthetic nucleic acid molecule
agcagctactccagagagtgaggt

SEQ ID NO: 6693 - DNA, 23 bp, Artificial Sequence
  Synthetic nucleic acid molecule
agcagctgcagcaggggtgagga

SEQ ID NO: 6694 - DNA, 23 bp, Artificial Sequence
  Synthetic nucleic acid molecule
agcaggggcagcatgagtgaggt

SEQ ID NO: 6695 - DNA, 24 bp, Artificial Sequence
  Synthetic nucleic acid molecule
agcaacgtgacctactagtgagga

SEQ ID NO: 6696 - DNA, 23 bp, Artificial Sequence
  Synthetic nucleic acid molecule
aacagcgtaagtacaagtgagga

SEQ ID NO: 6697 - DNA, 23 bp, Artificial Sequence
  Synthetic nucleic acid molecule
tgcaccgtcagtaacagtgagga

SEQ ID NO: 6698 - DNA, 24 bp, Artificial Sequence
  Synthetic nucleic acid molecule
agcagtgtgtcccaagagtgaggg

SEQ ID NO: 6699 - DNA, 24 bp, Artificial Sequence
  Synthetic nucleic acid molecule
agcagctgcaattatgagagagga

SEQ ID NO: 6700 - DNA, 24 bp, Artificial Sequence
  Synthetic nucleic acid molecule
agcaccttctagctagagtgagca

SEQ ID NO: 6701 - DNA, 23 bp, Artificial Sequence
  Synthetic nucleic acid molecule
agcaaggtcagaaggagtaagga

SEQ ID NO: 6702 - DNA, 24 bp, Artificial Sequence
  Synthetic nucleic acid molecule
agctgcgtgggagcagagtgaggc

SEQ ID NO: 6703 - DNA, 23 bp, Artificial Sequence
  Synthetic nucleic acid molecule
agcaaggtcctagtgagtgaaga

SEQ ID NO: 6704 - DNA, 23 bp, Artificial Sequence
  Synthetic nucleic acid molecule
agcagattcagaaggagtgaggg

SEQ ID NO: 6705 - DNA, 24 bp, Artificial Sequence
  Synthetic nucleic acid molecule
agcaaagtcattagagagtaagga

SEQ ID NO: 6706 - DNA, 23 bp, Artificial Sequence
  Synthetic nucleic acid molecule
tgcagggtcttcccgagtgaggg

SEQ ID NO: 6707 - DNA, 24 bp, Artificial Sequence
  Synthetic nucleic acid molecule
agcagaatcttctgggagtgaggt

SEQ ID NO: 6708 - DNA, 24 bp, Artificial Sequence
  Synthetic nucleic acid molecule
agctgagtccctagagagggagga

SEQ ID NO: 6709 - DNA, 24 bp, Artificial Sequence
  Synthetic nucleic acid molecule
agcattgtccagaaacagtgagga

SEQ ID NO: 6710 - DNA, 23 bp, Artificial Sequence
  Synthetic nucleic acid molecule
tgcagggtcccagcgagtgaggg

SEQ ID NO: 6711 - DNA, 24 bp, Artificial Sequence
  Synthetic nucleic acid molecule
agcaacttcatgtatgagtgtgga

SEQ ID NO: 6712 - DNA, 24 bp, Artificial Sequence
  Synthetic nucleic acid molecule
agcagctgcctgctggagtgaggg

SEQ ID NO: 6713 - DNA, 23 bp, Artificial Sequence
  Synthetic nucleic acid molecule
agcagggttggggagagggagga

SEQ ID NO: 6714 - DNA, 23 bp, Artificial Sequence
  Synthetic nucleic acid molecule
agcaaggtcactgagagtaagga

SEQ ID NO: 6715 - DNA, 23 bp, Artificial Sequence
  Synthetic nucleic acid molecule
agctgtgtcaaaggaagtgagga

SEQ ID NO: 6716 - DNA, 24 bp, Artificial Sequence
  Synthetic nucleic acid molecule
aacagcatcttaggggagtgaggg

SEQ ID NO: 6717 - DNA, 24 bp, Artificial Sequence
  Synthetic nucleic acid molecule
agaagcttctaggctgagtgaggc

SEQ ID NO: 6718 - DNA, 24 bp, Artificial Sequence
  Synthetic nucleic acid molecule
agcagagtttggggtgagtgagaa

SEQ ID NO: 6719 - DNA, 24 bp, Artificial Sequence
  Synthetic nucleic acid molecule
agcagagtttgctttgagtgagta

SEQ ID NO: 6720 - DNA, 24 bp, Artificial Sequence
  Synthetic nucleic acid molecule
aggagggtctgaagagagtgaggg

SEQ ID NO: 6721 - DNA, 24 bp, Artificial Sequence
  Synthetic nucleic acid molecule
agcaacttcagcaaagtgtgagga

SEQ ID NO: 6722 - DNA, 23 bp, Artificial Sequence
  Synthetic nucleic acid molecule
agcagctccctggagagtgaggg

SEQ ID NO: 6723 - DNA, 24 bp, Artificial Sequence
  Synthetic nucleic acid molecule
agcaaagtctgggagaagtgagga

SEQ ID NO: 6724 - DNA, 24 bp, Artificial Sequence
  Synthetic nucleic acid molecule
agcaacgtgacccctgagtgggga

SEQ ID NO: 6725 - DNA, 23 bp, Artificial Sequence
  Synthetic nucleic acid molecule
agcagggtgtataagagtgaggg

SEQ ID NO: 6726 - DNA, 24 bp, Artificial Sequence
  Synthetic nucleic acid molecule
agcaggttcttgggagagtgaggt

SEQ ID NO: 6727 - DNA, 23 bp, Artificial Sequence
  Synthetic nucleic acid molecule
agcagcttgtttctgagtgaggg

SEQ ID NO: 6728 - DNA, 24 bp, Artificial Sequence
  Synthetic nucleic acid molecule
agcagtgttgcattaaagtgagga

SEQ ID NO: 6729 - DNA, 24 bp, Artificial Sequence
  Synthetic nucleic acid molecule
agaggcgtctgagcagagtgaggg

SEQ ID NO: 6730 - DNA, 24 bp, Artificial Sequence
  Synthetic nucleic acid molecule
agcagtgacttaggaaagtgagga

SEQ ID NO: 6731 - DNA, 23 bp, Artificial Sequence
  Synthetic nucleic acid molecule
agcaccttccgagtgagtgagca

SEQ ID NO: 6732 - DNA, 23 bp, Artificial Sequence
  Synthetic nucleic acid molecule
atcagtgtctcctccagtgagga

SEQ ID NO: 6733 - DNA, 23 bp, Artificial Sequence
  Synthetic nucleic acid molecule
agcagcagcaggaagagtgaggc

SEQ ID NO: 6734 - DNA, 23 bp, Artificial Sequence
  Synthetic nucleic acid molecule
agcagtgacacctgaagtgagga

SEQ ID NO: 6735 - DNA, 24 bp, Artificial Sequence
  Synthetic nucleic acid molecule
agcagggttcacagggagggagga

SEQ ID NO: 6736 - DNA, 24 bp, Artificial Sequence
  Synthetic nucleic acid molecule
agctgcggcaggcccgagtgaggc

SEQ ID NO: 6737 - DNA, 23 bp, Artificial Sequence
  Synthetic nucleic acid molecule
agcaacatctgctacagtgagga

SEQ ID NO: 6738 - DNA, 23 bp, Artificial Sequence
  Synthetic nucleic acid molecule
agcaacgtataatctagtgagga

SEQ ID NO: 6739 - DNA, 24 bp, Artificial Sequence
  Synthetic nucleic acid molecule
agcaggatcgcctgtgagtgaggg

SEQ ID NO: 6740 - DNA, 24 bp, Artificial Sequence
  Synthetic nucleic acid molecule
agcagcaacatgggagagtgaggt

SEQ ID NO: 6741 - DNA, 24 bp, Artificial Sequence
  Synthetic nucleic acid molecule
agtagcggcttcacagagtgagaa

SEQ ID NO: 6742 - DNA, 23 bp, Artificial Sequence
  Synthetic nucleic acid molecule
agcagccccatcctgagtgaggg

SEQ ID NO: 6743 - DNA, 23 bp, Artificial Sequence
  Synthetic nucleic acid molecule
agcagctgccagaagagagagga

SEQ ID NO: 6744 - DNA, 23 bp, Artificial Sequence
  Synthetic nucleic acid molecule
agcaccgttgttagaagtgagga

SEQ ID NO: 6745 - DNA, 23 bp, Artificial Sequence
  Synthetic nucleic acid molecule
agcagggtggttaagagtgaggg

SEQ ID NO: 6746 - DNA, 24 bp, Artificial Sequence
  Synthetic nucleic acid molecule
agctgggtcttgggaaagtgagga

SEQ ID NO: 6747 - DNA, 23 bp, Artificial Sequence
  Synthetic nucleic acid molecule
accaccgtcgcggaaagtgagga

SEQ ID NO: 6748 - DNA, 23 bp, Artificial Sequence
  Synthetic nucleic acid molecule
agaagcttcagttggagtgaggt

SEQ ID NO: 6749 - DNA, 24 bp, Artificial Sequence
  Synthetic nucleic acid molecule
agcagaggcacctttgagtgaggt

SEQ ID NO: 6750 - DNA, 23 bp, Artificial Sequence
  Synthetic nucleic acid molecule
agcatcgttgagctcagtgagga

SEQ ID NO: 6751 - DNA, 23 bp, Artificial Sequence
  Synthetic nucleic acid molecule
agaagcgtgtgctggagtgaggc

SEQ ID NO: 6752 - DNA, 24 bp, Artificial Sequence
  Synthetic nucleic acid molecule
gacagcgtctgggaggtgtgagga

SEQ ID NO: 6753 - DNA, 24 bp, Artificial Sequence
  Synthetic nucleic acid molecule
agcagagacctgcatgagtgaggg

SEQ ID NO: 6754 - DNA, 24 bp, Artificial Sequence
  Synthetic nucleic acid molecule
agcaaagtcctaaggaagtgagga

SEQ ID NO: 6755 - DNA, 24 bp, Artificial Sequence
  Synthetic nucleic acid molecule
agcattgtctctagagaatgagga

SEQ ID NO: 6756 - DNA, 24 bp, Artificial Sequence
  Synthetic nucleic acid molecule
agcaaagtcttgagagagcgagga

SEQ ID NO: 6757 - DNA, 24 bp, Artificial Sequence
  Synthetic nucleic acid molecule
agcacagtccccgttgagagagga

SEQ ID NO: 6758 - DNA, 23 bp, Artificial Sequence
  Synthetic nucleic acid molecule
agcagcagcactgagagtgaggc

SEQ ID NO: 6759 - DNA, 24 bp, Artificial Sequence
  Synthetic nucleic acid molecule
agcagggtggggtgtgagtgaggt

SEQ ID NO: 6760 - DNA, 24 bp, Artificial Sequence
  Synthetic nucleic acid molecule
aggagcatcgcgcaggagtgaggc

SEQ ID NO: 6761 - DNA, 23 bp, Artificial Sequence
  Synthetic nucleic acid molecule
agctgggtcatgtgaagtgagga

SEQ ID NO: 6762 - DNA, 23 bp, Artificial Sequence
  Synthetic nucleic acid molecule
agctgtgtcatgacaagtgagga

SEQ ID NO: 6763 - DNA, 23 bp, Artificial Sequence
  Synthetic nucleic acid molecule
agctgtgtcatgacaagtgagga

SEQ ID NO: 6764 - DNA, 24 bp, Artificial Sequence
  Synthetic nucleic acid molecule
aggagcgtatcttctgagtgaggc

SEQ ID NO: 6765 - DNA, 23 bp, Artificial Sequence
  Synthetic nucleic acid molecule
agcagccacagccagagtgaggg

SEQ ID NO: 6766 - DNA, 24 bp, Artificial Sequence
  Synthetic nucleic acid molecule
agcagcatgtgcagggagtgaggc

SEQ ID NO: 6767 - DNA, 24 bp, Artificial Sequence
  Synthetic nucleic acid molecule
agcattgtcttttgagagtgagaa

SEQ ID NO: 6768 - DNA, 23 bp, Artificial Sequence
  Synthetic nucleic acid molecule
agcagcctggacgtgagtgaggt

SEQ ID NO: 6769 - DNA, 23 bp, Artificial Sequence
  Synthetic nucleic acid molecule
agcagctccagcgagagtgaggg

SEQ ID NO: 6770 - DNA, 24 bp, Artificial Sequence
  Synthetic nucleic acid molecule
agcagcagctagggagagtgaggc

SEQ ID NO: 6771 - DNA, 24 bp, Artificial Sequence
  Synthetic nucleic acid molecule
agcaacttcaatcaggagtgtgga

SEQ ID NO: 6772 - DNA, 23 bp, Artificial Sequence
  Synthetic nucleic acid molecule
agcagagtagctttgagtgaggg

SEQ ID NO: 6773 - DNA, 23 bp, Artificial Sequence
  Synthetic nucleic acid molecule
agcagccttgtgtggagtgaggt

SEQ ID NO: 6774 - DNA, 23 bp, Artificial Sequence
  Synthetic nucleic acid molecule
agcagtgtttctgaaagtgagga

SEQ ID NO: 6775 - DNA, 23 bp, Artificial Sequence
  Synthetic nucleic acid molecule
agaagcatctgtatgagtgaggc

SEQ ID NO: 6776 - DNA, 24 bp, Artificial Sequence
  Synthetic nucleic acid molecule
agcagggtaaacaaagagtgaggt

SEQ ID NO: 6777 - DNA, 24 bp, Artificial Sequence
  Synthetic nucleic acid molecule
agcagagttaggagagagtgaggg

SEQ ID NO: 6778 - DNA, 24 bp, Artificial Sequence
  Synthetic nucleic acid molecule
agcagaggctggggagagtgaggg

SEQ ID NO: 6779 - DNA, 23 bp, Artificial Sequence
  Synthetic nucleic acid molecule
agcaacatcttatagagtgagca

SEQ ID NO: 6780 - DNA, 23 bp, Artificial Sequence
  Synthetic nucleic acid molecule
agcagagtatgtcagagtgaggt

SEQ ID NO: 6781 - DNA, 23 bp, Artificial Sequence
  Synthetic nucleic acid molecule
agcatcgttgagctgagtgaaga

SEQ ID NO: 6782 - DNA, 24 bp, Artificial Sequence
  Synthetic nucleic acid molecule
agaagcttccagaatgagtgaggc

SEQ ID NO: 6783 - DNA, 24 bp, Artificial Sequence
  Synthetic nucleic acid molecule
atcagcggcagatggcagtgagga

SEQ ID NO: 6784 - DNA, 23 bp, Artificial Sequence
  Synthetic nucleic acid molecule
agcagaatctctgggagtgaggc

SEQ ID NO: 6785 - DNA, 23 bp, Artificial Sequence
  Synthetic nucleic acid molecule
agctacgtcaccttgagggagga

SEQ ID NO: 6786 - DNA, 23 bp, Artificial Sequence
  Synthetic nucleic acid molecule
agcaatgtcaacaagagtgagaa

SEQ ID NO: 6787 - DNA, 24 bp, Artificial Sequence
  Synthetic nucleic acid molecule
agcattgtcatggtggagggagga

SEQ ID NO: 6788 - DNA, 23 bp, Artificial Sequence
  Synthetic nucleic acid molecule
agcaccgccgggaaaagtgagga

SEQ ID NO: 6789 - DNA, 24 bp, Artificial Sequence
  Synthetic nucleic acid molecule
agcacggtcgggtactagtgagga

SEQ ID NO: 6790 - DNA, 23 bp, Artificial Sequence
  Synthetic nucleic acid molecule
agcaacatctatatgagtgagca

SEQ ID NO: 6791 - DNA, 23 bp, Artificial Sequence
  Synthetic nucleic acid molecule
agcagggttggagtgagggagga

SEQ ID NO: 6792 - DNA, 24 bp, Artificial Sequence
  Synthetic nucleic acid molecule
agcagctgcagcaccgagtgaggg

SEQ ID NO: 6793 - DNA, 24 bp, Artificial Sequence
  Synthetic nucleic acid molecule
agcagtgtgtgggaggagtgaggg

SEQ ID NO: 6794 - DNA, 23 bp, Artificial Sequence
  Synthetic nucleic acid molecule
aacagagtctggttgagtgaggc

SEQ ID NO: 6795 - DNA, 23 bp, Artificial Sequence
  Synthetic nucleic acid molecule
ggcagtgtctggcaaagtgagga

SEQ ID NO: 6796 - DNA, 24 bp, Artificial Sequence
  Synthetic nucleic acid molecule
agcagtgtgtgggaggagtgaggg

SEQ ID NO: 6797 - DNA, 24 bp, Artificial Sequence
  Synthetic nucleic acid molecule
agcaaggtccagacaaagtgagga

SEQ ID NO: 6798 - DNA, 24 bp, Artificial Sequence
  Synthetic nucleic acid molecule
agcagtgtgtgggaggagtgaggg

SEQ ID NO: 6799 - DNA, 24 bp, Artificial Sequence
  Synthetic nucleic acid molecule
agcagtgtgtgggaggagtgaggg

SEQ ID NO: 6800 - DNA, 24 bp, Artificial Sequence
  Synthetic nucleic acid molecule
agcagtgtgtgggaggagtgaggg

SEQ ID NO: 6801 - DNA, 24 bp, Artificial Sequence
  Synthetic nucleic acid molecule
agcagtgtgtgggaggagtgaggg

SEQ ID NO: 6802 - DNA, 24 bp, Artificial Sequence
  Synthetic nucleic acid molecule
agcagtgtgtgggaggagtgaggg

SEQ ID NO: 6803 - DNA, 23 bp, Artificial Sequence
  Synthetic nucleic acid molecule
agcagcatgagagggagtgaggg

SEQ ID NO: 6804 - DNA, 23 bp, Artificial Sequence
  Synthetic nucleic acid molecule
agcactgtcattataagtgagga

SEQ ID NO: 6805 - DNA, 24 bp, Artificial Sequence
  Synthetic nucleic acid molecule
ggcagtgtctggaaaaagtgagga

SEQ ID NO: 6806 - DNA, 24 bp, Artificial Sequence
  Synthetic nucleic acid molecule
cacagcgtcaccctggagtgagaa

SEQ ID NO: 6807 - DNA, 24 bp, Artificial Sequence
  Synthetic nucleic acid molecule
agcaccttcctggctgagtgaggg

SEQ ID NO: 6808 - DNA, 24 bp, Artificial Sequence
  Synthetic nucleic acid molecule
agcacagtcccaaatgagtgagaa

SEQ ID NO: 6809 - DNA, 23 bp, Artificial Sequence
  Synthetic nucleic acid molecule
agcagattctggtagagtgaggg

SEQ ID NO: 6810 - DNA, 23 bp, Artificial Sequence
  Synthetic nucleic acid molecule
aggagggtcagcctgagtgaggg

SEQ ID NO: 6811 - DNA, 23 bp, Artificial Sequence
  Synthetic nucleic acid molecule
agcaacgtggcgggaagtgagga

SEQ ID NO: 6812 - DNA, 24 bp, Artificial Sequence
  Synthetic nucleic acid molecule
agcggcgttgagcttgagtgaggc

SEQ ID NO: 6813 - DNA, 23 bp, Artificial Sequence
  Synthetic nucleic acid molecule
aggagtgtctgggtgagtgaggt

SEQ ID NO: 6814 - DNA, 24 bp, Artificial Sequence
  Synthetic nucleic acid molecule
agctgcttcactgatgagtgaggc

SEQ ID NO: 6815 - DNA, 23 bp, Artificial Sequence
  Synthetic nucleic acid molecule
agcaacatccactgcagtgagga

SEQ ID NO: 6816 - DNA, 24 bp, Artificial Sequence
  Synthetic nucleic acid molecule
agcatagtcggacaatagtgagga

SEQ ID NO: 6817 - DNA, 24 bp, Artificial Sequence
  Synthetic nucleic acid molecule
agcaacatcaaacctgagagagga

SEQ ID NO: 6818 - DNA, 23 bp, Artificial Sequence
  Synthetic nucleic acid molecule
ggcagcgcccatctgagtgaggg

SEQ ID NO: 6819 - DNA, 23 bp, Artificial Sequence
  Synthetic nucleic acid molecule
agcagagtgtccaagagtgaggg

SEQ ID NO: 6820 - DNA, 24 bp, Artificial Sequence
  Synthetic nucleic acid molecule
agcaaagtcctagatgagggagga

SEQ ID NO: 6821 - DNA, 23 bp, Artificial Sequence
  Synthetic nucleic acid molecule
gacagcgtcacacacagtgagga

SEQ ID NO: 6822 - DNA, 23 bp, Artificial Sequence
  Synthetic nucleic acid molecule
agcggcggctggatgagtgaggg

SEQ ID NO: 6823 - DNA, 23 bp, Artificial Sequence
  Synthetic nucleic acid molecule
agccgcatcatcaagagtgaggc

SEQ ID NO: 6824 - DNA, 23 bp, Artificial Sequence
  Synthetic nucleic acid molecule
agcaaagtccccaggagggagga

SEQ ID NO: 6825 - DNA, 23 bp, Artificial Sequence
  Synthetic nucleic acid molecule
agcaggttctaagagagtgaggt

SEQ ID NO: 6826 - DNA, 23 bp, Artificial Sequence
  Synthetic nucleic acid molecule
agctgggtcacacgaagtgagga

SEQ ID NO: 6827 - DNA, 24 bp, Artificial Sequence
  Synthetic nucleic acid molecule
agcagagactgaatggagtgaggg

SEQ ID NO: 6828 - DNA, 24 bp, Artificial Sequence
  Synthetic nucleic acid molecule
agcagaggcttaaaggagtgaggg

SEQ ID NO: 6829 - DNA, 24 bp, Artificial Sequence
  Synthetic nucleic acid molecule
agctgagtctagccaaagtgagga

SEQ ID NO: 6830 - DNA, 23 bp, Artificial Sequence
  Synthetic nucleic acid molecule
agtagagtcttccagagtgagaa

SEQ ID NO: 6831 - DNA, 23 bp, Artificial Sequence
  Synthetic nucleic acid molecule
tgcagcgacaacaggagtgaggt

SEQ ID NO: 6832 - DNA, 23 bp, Artificial Sequence
  Synthetic nucleic acid molecule
agcagctgcctccggagagagga

SEQ ID NO: 6833 - DNA, 23 bp, Artificial Sequence
  Synthetic nucleic acid molecule
agcagcatggccctgagtgaggg

SEQ ID NO: 6834 - DNA, 23 bp, Artificial Sequence
  Synthetic nucleic acid molecule
agctgagtcccaaagagtgagaa

SEQ ID NO: 6835 - DNA, 23 bp, Artificial Sequence
  Synthetic nucleic acid molecule
agcaacatctgctacagtgagga

SEQ ID NO: 6836 - DNA, 23 bp, Artificial Sequence
  Synthetic nucleic acid molecule
agcaacatctgctacagtgagga

SEQ ID NO: 6837 - DNA, 23 bp, Artificial Sequence
  Synthetic nucleic acid molecule
accagcttcctgctgagtgaggt

SEQ ID NO: 6838 - DNA, 23 bp, Artificial Sequence
  Synthetic nucleic acid molecule
agcagcattattctgagtgaggg

SEQ ID NO: 6839 - DNA, 24 bp, Artificial Sequence
  Synthetic nucleic acid molecule
aggagtgtcgacaaggagtgaggg

SEQ ID NO: 6840 - DNA, 23 bp, Artificial Sequence
  Synthetic nucleic acid molecule
agaagcggctgcaggagtgaggg

SEQ ID NO: 6841 - DNA, 24 bp, Artificial Sequence
  Synthetic nucleic acid molecule
agcagccacagactagagtgaggc

SEQ ID NO: 6842 - DNA, 23 bp, Artificial Sequence
  Synthetic nucleic acid molecule
agcagcagcagcaggagtgaggc

SEQ ID NO: 6843 - DNA, 24 bp, Artificial Sequence
  Synthetic nucleic acid molecule
agcacagtccgcagggagggagga

SEQ ID NO: 6844 - DNA, 24 bp, Artificial Sequence
  Synthetic nucleic acid molecule
agctgcggcgaatgagagtgaggg

SEQ ID NO: 6845 - DNA, 23 bp, Artificial Sequence
  Synthetic nucleic acid molecule
agcaaggtcttatagggtgagga

SEQ ID NO: 6846 - DNA, 23 bp, Artificial Sequence
  Synthetic nucleic acid molecule
agcaccttctccatgagtgggga

SEQ ID NO: 6847 - DNA, 24 bp, Artificial Sequence
  Synthetic nucleic acid molecule
agcagcatgatcctggagtgaggc

SEQ ID NO: 6848 - DNA, 24 bp, Artificial Sequence
  Synthetic nucleic acid molecule
agcaaggtcaagagagagtgagca

SEQ ID NO: 6849 - DNA, 24 bp, Artificial Sequence
  Synthetic nucleic acid molecule
agcatggtcaaagctgagtgagaa

SEQ ID NO: 6850 - DNA, 24 bp, Artificial Sequence
  Synthetic nucleic acid molecule
agcagcatgatcttggagtgaggc

SEQ ID NO: 6851 - DNA, 24 bp, Artificial Sequence
  Synthetic nucleic acid molecule
agcagggtggggtgtgagtgaggt

SEQ ID NO: 6852 - DNA, 23 bp, Artificial Sequence
  Synthetic nucleic acid molecule
agaggtgtcgccatgagtgagga

SEQ ID NO: 6853 - DNA, 23 bp, Artificial Sequence
  Synthetic nucleic acid molecule
gtcagggtcatcaggagtgagga

SEQ ID NO: 6854 - DNA, 24 bp, Artificial Sequence
  Synthetic nucleic acid molecule
tgcactgtctctcccgagtgagga

SEQ ID NO: 6855 - DNA, 24 bp, Artificial Sequence
  Synthetic nucleic acid molecule
tgcggagtcgagggtgagtgagga

SEQ ID NO: 6856 - DNA, 24 bp, Artificial Sequence
  Synthetic nucleic acid molecule
agaaacgttcttgctgagtgagga

SEQ ID NO: 6857 - DNA, 23 bp, Artificial Sequence
  Synthetic nucleic acid molecule
aggagcaacatgctgagtgagga

SEQ ID NO: 6858 - DNA, 24 bp, Artificial Sequence
  Synthetic nucleic acid molecule
cgctgtgtccccggggagtgagga

SEQ ID NO: 6859 - DNA, 24 bp, Artificial Sequence
  Synthetic nucleic acid molecule
agcgtggtcactagggagtgagga

SEQ ID NO: 6860 - DNA, 23 bp, Artificial Sequence
  Synthetic nucleic acid molecule
agcaggtccttgaagagtgagga

SEQ ID NO: 6861 - DNA, 24 bp, Artificial Sequence
  Synthetic nucleic acid molecule
ggctgtgtcattcaggagtgagga

SEQ ID NO: 6862 - DNA, 24 bp, Artificial Sequence
  Synthetic nucleic acid molecule
tgcagagttagaggtgagtgagga

SEQ ID NO: 6863 - DNA, 24 bp, Artificial Sequence
  Synthetic nucleic acid molecule
atcatggtcagaaaagagtgagga

SEQ ID NO: 6864 - DNA, 24 bp, Artificial Sequence
  Synthetic nucleic acid molecule
agcaacgcggtgagggagtgagga

SEQ ID NO: 6865 - DNA, 23 bp, Artificial Sequence
  Synthetic nucleic acid molecule
tgaagtgtcagctcgagtgagga

SEQ ID NO: 6866 - DNA, 23 bp, Artificial Sequence
  Synthetic nucleic acid molecule
agcaactccgtcttgagtgagga

SEQ ID NO: 6867 - DNA, 24 bp, Artificial Sequence
  Synthetic nucleic acid molecule
agaaatgtcttccaggagtgagga

SEQ ID NO: 6868 - DNA, 24 bp, Artificial Sequence
  Synthetic nucleic acid molecule
ggcagggtatcacaggagtgagga

SEQ ID NO: 6869 - DNA, 23 bp, Artificial Sequence
  Synthetic nucleic acid molecule
agcaacatggagttgagtgagga

SEQ ID NO: 6870 - DNA, 24 bp, Artificial Sequence
  Synthetic nucleic acid molecule
gacagcgtggccagtgagtgagga

SEQ ID NO: 6871 - DNA, 23 bp, Artificial Sequence
  Synthetic nucleic acid molecule
ggctgagtcactctgagtgagga

SEQ ID NO: 6872 - DNA, 23 bp, Artificial Sequence
  Synthetic nucleic acid molecule
tgcagagttttgtggagtgagga

SEQ ID NO: 6873 - DNA, 24 bp, Artificial Sequence
  Synthetic nucleic acid molecule
agctgagtgctggatgagtgagga

SEQ ID NO: 6874 - DNA, 23 bp, Artificial Sequence
  Synthetic nucleic acid molecule
aactgagtctctgagagtgagga

SEQ ID NO: 6875 - DNA, 24 bp, Artificial Sequence
  Synthetic nucleic acid molecule
aacatagtctgtacagagtgagga

SEQ ID NO: 6876 - DNA, 23 bp, Artificial Sequence
  Synthetic nucleic acid molecule
agctgggtgacagtgagtgagga

SEQ ID NO: 6877 - DNA, 23 bp, Artificial Sequence
  Synthetic nucleic acid molecule
agcaccatatggctgagtgagga

SEQ ID NO: 6878 - DNA, 23 bp, Artificial Sequence
  Synthetic nucleic acid molecule
atcaggttccttctgagtgagga

SEQ ID NO: 6879 - DNA, 24 bp, Artificial Sequence
  Synthetic nucleic acid molecule
accacggtcaggtctgagtgagga

SEQ ID NO: 6880 - DNA, 24 bp, Artificial Sequence
  Synthetic nucleic acid molecule
accacggtcaggtctgagtgagga

SEQ ID NO: 6881 - DNA, 24 bp, Artificial Sequence
  Synthetic nucleic acid molecule
accacggtcaggtctgagtgagga

SEQ ID NO: 6882 - DNA, 24 bp, Artificial Sequence
  Synthetic nucleic acid molecule
accacggtcaggtctgagtgagga

SEQ ID NO: 6883 - DNA, 24 bp, Artificial Sequence
  Synthetic nucleic acid molecule
accatggtcaagtctgagtgagga

SEQ ID NO: 6884 - DNA, 23 bp, Artificial Sequence
  Synthetic nucleic acid molecule
agaaacttcctctcgagtgagga

SEQ ID NO: 6885 - DNA, 24 bp, Artificial Sequence
  Synthetic nucleic acid molecule
cacagcttctcacaggagtgagga

SEQ ID NO: 6886 - DNA, 23 bp, Artificial Sequence
  Synthetic nucleic acid molecule
atcatggtcttagagagtgagga

SEQ ID NO: 6887 - DNA, 23 bp, Artificial Sequence
  Synthetic nucleic acid molecule
agcagtgattgagggagtgagga

SEQ ID NO: 6888 - DNA, 23 bp, Artificial Sequence
  Synthetic nucleic acid molecule
accaaggtcacactgagtgagga

SEQ ID NO: 6889 - DNA, 24 bp, Artificial Sequence
  Synthetic nucleic acid molecule
agccccttcctagaggagtgagga

SEQ ID NO: 6890 - DNA, 24 bp, Artificial Sequence
  Synthetic nucleic acid molecule
ctcagtgtctaagcagagtgagga

SEQ ID NO: 6891 - DNA, 23 bp, Artificial Sequence
  Synthetic nucleic acid molecule
agttgcttcctgaggagtgagga

SEQ ID NO: 6892 - DNA, 23 bp, Artificial Sequence
  Synthetic nucleic acid molecule
aagagagtctgaaagagtgagga

SEQ ID NO: 6893 - DNA, 24 bp, Artificial Sequence
  Synthetic nucleic acid molecule
ggcagtgtggtcaccgagtgagga

SEQ ID NO: 6894 - DNA, 24 bp, Artificial Sequence
  Synthetic nucleic acid molecule
tgcagagttgggtcagagtgagga

SEQ ID NO: 6895 - DNA, 24 bp, Artificial Sequence
  Synthetic nucleic acid molecule
agcctcgttgccagagagtgagga

SEQ ID NO: 6896 - DNA, 24 bp, Artificial Sequence
  Synthetic nucleic acid molecule
atcatcttcaagtaagagtgagga

SEQ ID NO: 6897 - DNA, 24 bp, Artificial Sequence
  Synthetic nucleic acid molecule
agtagtgtgtgaagggagtgagga

SEQ ID NO: 6898 - DNA, 24 bp, Artificial Sequence
  Synthetic nucleic acid molecule
agcctcgtgtcctcagagtgagga

SEQ ID NO: 6899 - DNA, 24 bp, Artificial Sequence
  Synthetic nucleic acid molecule
aaaagcgtttgggaagagtgagga

SEQ ID NO: 6900 - DNA, 24 bp, Artificial Sequence
  Synthetic nucleic acid molecule
actagagtcccccaagagtgagga

SEQ ID NO: 6901 - DNA, 23 bp, Artificial Sequence
  Synthetic nucleic acid molecule
ggcggcggcgaagggagtgagga

SEQ ID NO: 6902 - DNA, 23 bp, Artificial Sequence
  Synthetic nucleic acid molecule
atgagagtcctggggagtgagga

SEQ ID NO: 6903 - DNA, 24 bp, Artificial Sequence
  Synthetic nucleic acid molecule
agcacagtggcctgagagtgagga

SEQ ID NO: 6904 - DNA, 24 bp, Artificial Sequence
  Synthetic nucleic acid molecule
tacagggtcctcggtgagtgagga

SEQ ID NO: 6905 - DNA, 23 bp, Artificial Sequence
  Synthetic nucleic acid molecule
agcagaggtgctgagagtgagga

SEQ ID NO: 6906 - DNA, 23 bp, Artificial Sequence
  Synthetic nucleic acid molecule
ggaagagtccaggggagtgagga

SEQ ID NO: 6907 - DNA, 23 bp, Artificial Sequence
  Synthetic nucleic acid molecule
ggaagagtccaggggagtgagga

SEQ ID NO: 6908 - DNA, 24 bp, Artificial Sequence
  Synthetic nucleic acid molecule
agtggggtctgttgggagtgagga

SEQ ID NO: 6909 - DNA, 24 bp, Artificial Sequence
  Synthetic nucleic acid molecule
atgagggtcactgaggagtgagga

SEQ ID NO: 6910 - DNA, 23 bp, Artificial Sequence
  Synthetic nucleic acid molecule
gtcagagtcctagggagtgagga

SEQ ID NO: 6911 - DNA, 24 bp, Artificial Sequence
  Synthetic nucleic acid molecule
gccagggtctgggaggagtgagga

SEQ ID NO: 6912 - DNA, 23 bp, Artificial Sequence
  Synthetic nucleic acid molecule
agcaactccatcttgagtgagga

SEQ ID NO: 6913 - DNA, 23 bp, Artificial Sequence
  Synthetic nucleic acid molecule
aggggagtcgacaggagtgagga

SEQ ID NO: 6914 - DNA, 23 bp, Artificial Sequence
  Synthetic nucleic acid molecule
gtcagggtcatcaggagtgagga

SEQ ID NO: 6915 - DNA, 23 bp, Artificial Sequence
  Synthetic nucleic acid molecule
gtcagggtcatcaggagtgagga

SEQ ID NO: 6916 - DNA, 23 bp, Artificial Sequence
  Synthetic nucleic acid molecule
agcatagtagttaagagtgagga

SEQ ID NO: 6917 - DNA, 23 bp, Artificial Sequence
  Synthetic nucleic acid molecule
gtcagagtccaaaagagtgagga

SEQ ID NO: 6918 - DNA, 23 bp, Artificial Sequence
  Synthetic nucleic acid molecule
ggcagtgttacaaagagtgagga

SEQ ID NO: 6919 - DNA, 23 bp, Artificial Sequence
  Synthetic nucleic acid molecule
gccatcgtcacccagagtgagga

SEQ ID NO: 6920 - DNA, 24 bp, Artificial Sequence
  Synthetic nucleic acid molecule
ctcagtgtcgagagagagtgagga

SEQ ID NO: 6921 - DNA, 24 bp, Artificial Sequence
  Synthetic nucleic acid molecule
ggaagagtcaagggagagtgagga

SEQ ID NO: 6922 - DNA, 24 bp, Artificial Sequence
  Synthetic nucleic acid molecule
agcaactccagaagagagtgagga

SEQ ID NO: 6923 - DNA, 24 bp, Artificial Sequence
  Synthetic nucleic acid molecule
agcctcggcggccctgagtgagga

SEQ ID NO: 6924 - DNA, 24 bp, Artificial Sequence
  Synthetic nucleic acid molecule
gacagggtcactttagagtgagga

SEQ ID NO: 6925 - DNA, 23 bp, Artificial Sequence
  Synthetic nucleic acid molecule
agaatagtcctggggagtgagga

SEQ ID NO: 6926 - DNA, 24 bp, Artificial Sequence
  Synthetic nucleic acid molecule
agtagagtagtaaaggagtgagga

SEQ ID NO: 6927 - DNA, 24 bp, Artificial Sequence
  Synthetic nucleic acid molecule
gggagggtcggtcaggagtgagga

SEQ ID NO: 6928 - DNA, 23 bp, Artificial Sequence
  Synthetic nucleic acid molecule
aacagggttatccagagtgagga

SEQ ID NO: 6929 - DNA, 23 bp, Artificial Sequence
  Synthetic nucleic acid molecule
gccagggtcacccagagtgagga

SEQ ID NO: 6930 - DNA, 24 bp, Artificial Sequence
  Synthetic nucleic acid molecule
ggaagagtcttacctgagtgagga

SEQ ID NO: 6931 - DNA, 24 bp, Artificial Sequence
  Synthetic nucleic acid molecule
agtggagtcaccgtagagtgagga

SEQ ID NO: 6932 - DNA, 24 bp, Artificial Sequence
  Synthetic nucleic acid molecule
gccagagtcacccttgagtgagga

SEQ ID NO: 6933 - DNA, 24 bp, Artificial Sequence
  Synthetic nucleic acid molecule
ggcagtgtaacttaagagtgagga

SEQ ID NO: 6934 - DNA, 23 bp, Artificial Sequence
  Synthetic nucleic acid molecule
ctcagtgtcgttgtgagtgagga

SEQ ID NO: 6935 - DNA, 24 bp, Artificial Sequence
  Synthetic nucleic acid molecule
agatgggtctacagagagtgagga

SEQ ID NO: 6936 - DNA, 24 bp, Artificial Sequence
  Synthetic nucleic acid molecule
gccagagtctgagtggagtgagga

SEQ ID NO: 6937 - DNA, 23 bp, Artificial Sequence
  Synthetic nucleic acid molecule
agtagggtttgaatgagtgagga

SEQ ID NO: 6938 - DNA, 24 bp, Artificial Sequence
  Synthetic nucleic acid molecule
cactgcgtccttggtgagtgagga

SEQ ID NO: 6939 - DNA, 24 bp, Artificial Sequence
  Synthetic nucleic acid molecule
aactgggtccctgaggagtgagga

SEQ ID NO: 6940 - DNA, 24 bp, Artificial Sequence
  Synthetic nucleic acid molecule
agtaacatcagtagtgagtgagga

SEQ ID NO: 6941 - DNA, 24 bp, Artificial Sequence
  Synthetic nucleic acid molecule
gacagagtccacagagagtgagga

SEQ ID NO: 6942 - DNA, 23 bp, Artificial Sequence
  Synthetic nucleic acid molecule
atcaggttccaatagagtgagga

SEQ ID NO: 6943 - DNA, 23 bp, Artificial Sequence
  Synthetic nucleic acid molecule
agcatggtagtggggagtgagga

SEQ ID NO: 6944 - DNA, 24 bp, Artificial Sequence
  Synthetic nucleic acid molecule
agcaactgcccttctgagtgagga

SEQ ID NO: 6945 - DNA, 24 bp, Artificial Sequence
  Synthetic nucleic acid molecule
ggctgagtcttgcaggagtgagga

SEQ ID NO: 6946 - DNA, 24 bp, Artificial Sequence
  Synthetic nucleic acid molecule
agcagcccagggggtgagtgagga

SEQ ID NO: 6947 - DNA, 23 bp, Artificial Sequence
  Synthetic nucleic acid molecule
agcaaagtgtcaatgagtgagga

SEQ ID NO: 6948 - DNA, 24 bp, Artificial Sequence
  Synthetic nucleic acid molecule
agaaaagtccacagggagtgagga

SEQ ID NO: 6949 - DNA, 23 bp, Artificial Sequence
  Synthetic nucleic acid molecule
aacaacttctcctggagtgagga

SEQ ID NO: 6950 - DNA, 24 bp, Artificial Sequence
  Synthetic nucleic acid molecule
tgcggagtccctggggagtgagga

SEQ ID NO: 6951 - DNA, 24 bp, Artificial Sequence
  Synthetic nucleic acid molecule
agaatggtctctgatgagtgagga

SEQ ID NO: 6952 - DNA, 24 bp, Artificial Sequence
  Synthetic nucleic acid molecule
agcagcagaacaactgagtgagga

SEQ ID NO: 6953 - DNA, 23 bp, Artificial Sequence
  Synthetic nucleic acid molecule
agcagcagatattggagtgagga

SEQ ID NO: 6954 - DNA, 24 bp, Artificial Sequence
  Synthetic nucleic acid molecule
agttgcttcttctaagagtgagga

SEQ ID NO: 6955 - DNA, 23 bp, Artificial Sequence
  Synthetic nucleic acid molecule
gacagggtcctggagagtgagga

SEQ ID NO: 6956 - DNA, 23 bp, Artificial Sequence
  Synthetic nucleic acid molecule
ggaagagtccgggggagtgagga

SEQ ID NO: 6957 - DNA, 23 bp, Artificial Sequence
  Synthetic nucleic acid molecule
ggaagagtccaaaggagtgagga

SEQ ID NO: 6958 - DNA, 24 bp, Artificial Sequence
  Synthetic nucleic acid molecule
aggggggtcaagagtgagtgagga

SEQ ID NO: 6959 - DNA, 23 bp, Artificial Sequence
  Synthetic nucleic acid molecule
aacaacttccatgtgagtgagga

SEQ ID NO: 6960 - DNA, 24 bp, Artificial Sequence
  Synthetic nucleic acid molecule
accaaggtcagcagggagtgagga

SEQ ID NO: 6961 - DNA, 24 bp, Artificial Sequence
  Synthetic nucleic acid molecule
ggccacgtcgcacaggagtgagga

SEQ ID NO: 6962 - DNA, 24 bp, Artificial Sequence
  Synthetic nucleic acid molecule
agcaaggttaggaaggagtgagga

SEQ ID NO: 6963 - DNA, 24 bp, Artificial Sequence
  Synthetic nucleic acid molecule
agtagggttggaggggagtgagga

SEQ ID NO: 6964 - DNA, 24 bp, Artificial Sequence
  Synthetic nucleic acid molecule
agcagcgtcacaaaatagcaaggt

SEQ ID NO: 6965 - DNA, 23 bp, Artificial Sequence
  Synthetic nucleic acid molecule
agcagcgtcaaggggagacaagt

SEQ ID NO: 6966 - DNA, 24 bp, Artificial Sequence
  Synthetic nucleic acid molecule
agcagcgtccgtcccgagaggcgc

SEQ ID NO: 6967 - DNA, 23 bp, Artificial Sequence
  Synthetic nucleic acid molecule
agcagcggcctagcgggtgagtc

SEQ ID NO: 6968 - DNA, 23 bp, Artificial Sequence
  Synthetic nucleic acid molecule
agcagcgttgctatgagaaaggt

SEQ ID NO: 6969 - DNA, 24 bp, Artificial Sequence
  Synthetic nucleic acid molecule
agcaacgtcatgtgctggggagga

SEQ ID NO: 6970 - DNA, 23 bp, Artificial Sequence
  Synthetic nucleic acid molecule
agcagcggccggagaagtgtggg

SEQ ID NO: 6971 - DNA, 23 bp, Artificial Sequence
  Synthetic nucleic acid molecule
agcaacgtctgtttgtgtaaggc

SEQ ID NO: 6972 - DNA, 23 bp, Artificial Sequence
  Synthetic nucleic acid molecule
agcaacgtcacctggagtcacgc

SEQ ID NO: 6973 - DNA, 24 bp, Artificial Sequence
  Synthetic nucleic acid molecule
agcagtgtcatgatggtgtgtgaa

SEQ ID NO: 6974 - DNA, 24 bp, Artificial Sequence
  Synthetic nucleic acid molecule
agcagcggccacatagtgtgtgaa

SEQ ID NO: 6975 - DNA, 24 bp, Artificial Sequence
  Synthetic nucleic acid molecule
agcaacgtccagtccaagtgtggc

SEQ ID NO: 6976 - DNA, 24 bp, Artificial Sequence
  Synthetic nucleic acid molecule
agcaacgtcggatgcaggtgagca

SEQ ID NO: 6977 - DNA, 24 bp, Artificial Sequence
  Synthetic nucleic acid molecule
atcagcgtccagatggtgtgagtc

SEQ ID NO: 6978 - DNA, 23 bp, Artificial Sequence
  Synthetic nucleic acid molecule
agcaacgtccttactagtgaata

SEQ ID NO: 6979 - DNA, 23 bp, Artificial Sequence
  Synthetic nucleic acid molecule
agcaacgtcgtgacgtgcgatga

SEQ ID NO: 6980 - DNA, 24 bp, Artificial Sequence
  Synthetic nucleic acid molecule
agcagtgtctgtctggagtgttgc

SEQ ID NO: 6981 - DNA, 24 bp, Artificial Sequence
  Synthetic nucleic acid molecule
agcagcgttgttttgatgtgaggc

SEQ ID NO: 6982 - DNA, 23 bp, Artificial Sequence
  Synthetic nucleic acid molecule
agcaacgtctgtgtgagtgacag

SEQ ID NO: 6983 - DNA, 23 bp, Artificial Sequence
  Synthetic nucleic acid molecule
agcaccgtctgccggtgtgcggt

SEQ ID NO: 6984 - DNA, 24 bp, Artificial Sequence
  Synthetic nucleic acid molecule
agcaacgtccagtccaagtgtggc

SEQ ID NO: 6985 - DNA, 24 bp, Artificial Sequence
  Synthetic nucleic acid molecule
agcattgtcttgtgggagtaaggc

SEQ ID NO: 6986 - DNA, 24 bp, Artificial Sequence
  Synthetic nucleic acid molecule
agcagcgatggggttgagtgagac

SEQ ID NO: 6987 - DNA, 24 bp, Artificial Sequence
  Synthetic nucleic acid molecule
agctgtgtcatccatgagtgagtc

SEQ ID NO: 6988 - DNA, 24 bp, Artificial Sequence
  Synthetic nucleic acid molecule
agcatggtcaagttctagtgaggg

SEQ ID NO: 6989 - DNA, 24 bp, Artificial Sequence
  Synthetic nucleic acid molecule
agcatggtcaagttctagtgaggg

SEQ ID NO: 6990 - DNA, 23 bp, Artificial Sequence
  Synthetic nucleic acid molecule
agcatcttcatatggagtgagag

SEQ ID NO: 6991 - DNA, 24 bp, Artificial Sequence
  Synthetic nucleic acid molecule
agcatggtcaggttctagtgaggg

SEQ ID NO: 6992 - DNA, 23 bp, Artificial Sequence
  Synthetic nucleic acid molecule
agcatagtcaaggggagtgagag

SEQ ID NO: 6993 - DNA, 24 bp, Artificial Sequence
  Synthetic nucleic acid molecule
agcatggtctctttctagtgaggg

SEQ ID NO: 6994 - DNA, 24 bp, Artificial Sequence
  Synthetic nucleic acid molecule
agcatggtcaggttctagtgaggg

SEQ ID NO: 6995 - DNA, 24 bp, Artificial Sequence
  Synthetic nucleic acid molecule
agcatagtctttattgagtgagag

SEQ ID NO: 6996 - DNA, 24 bp, Artificial Sequence
  Synthetic nucleic acid molecule
agcaaagtcctgaaggagtgagag

SEQ ID NO: 6997 - DNA, 24 bp, Artificial Sequence
  Synthetic nucleic acid molecule
agcagcgcaaagcacgtgtgaggc

SEQ ID NO: 6998 - DNA, 23 bp, Artificial Sequence
  Synthetic nucleic acid molecule
atcaacgtctggactagtgaggg

SEQ ID NO: 6999 - DNA, 23 bp, Artificial Sequence
  Synthetic nucleic acid molecule
agtagtgtccacagaagtgaggg

SEQ ID NO: 7000 - DNA, 23 bp, Artificial Sequence
  Synthetic nucleic acid molecule
agcaaagtcccttggagtgagtg

SEQ ID NO: 7001 - DNA, 24 bp, Artificial Sequence
  Synthetic nucleic acid molecule
agccacgtctatgctttgtgagga

SEQ ID NO: 7002 - DNA, 24 bp, Artificial Sequence
  Synthetic nucleic acid molecule
agcatggtcgggttctagtgaggg

SEQ ID NO: 7003 - DNA, 24 bp, Artificial Sequence
  Synthetic nucleic acid molecule
agcagagttgggaaaaagtgaggg

SEQ ID NO: 7004 - DNA, 23 bp, Artificial Sequence
  Synthetic nucleic acid molecule
agcattgtcactgtgagtgagag

SEQ ID NO: 7005 - DNA, 24 bp, Artificial Sequence
  Synthetic nucleic acid molecule
agcatggtcaggttctagtgaggg

SEQ ID NO: 7006 - DNA, 24 bp, Artificial Sequence
  Synthetic nucleic acid molecule
agcatggtcaggttctagtgaggg

SEQ ID NO: 7007 - DNA, 23 bp, Artificial Sequence
  Synthetic nucleic acid molecule
agcatggtctagcagagtgagtc

SEQ ID NO: 7008 - DNA, 24 bp, Artificial Sequence
  Synthetic nucleic acid molecule
agctgtgtcatccatgagtgagtc

SEQ ID NO: 7009 - DNA, 24 bp, Artificial Sequence
  Synthetic nucleic acid molecule
agtagagtctgggtggagtgagac

SEQ ID NO: 7010 - DNA, 24 bp, Artificial Sequence
  Synthetic nucleic acid molecule
agcatggtcaggttctagtgaggg

SEQ ID NO: 7011 - DNA, 24 bp, Artificial Sequence
  Synthetic nucleic acid molecule
agctgtgtccaggaggagtgagtc

SEQ ID NO: 7012 - DNA, 23 bp, Artificial Sequence
  Synthetic nucleic acid molecule
agcaacttctgatctagtgaggt

SEQ ID NO: 7013 - DNA, 23 bp, Artificial Sequence
  Synthetic nucleic acid molecule
agctgagtcaacctgagtaaggg

SEQ ID NO: 7014 - DNA, 23 bp, Artificial Sequence
  Synthetic nucleic acid molecule
agtagggtcatcagaagtgaggt

SEQ ID NO: 7015 - DNA, 23 bp, Artificial Sequence
  Synthetic nucleic acid molecule
agctgtgtcaccttgagtgagtc

SEQ ID NO: 7016 - DNA, 23 bp, Artificial Sequence
  Synthetic nucleic acid molecule
agcaacatctggaagagtgagag

SEQ ID NO: 7017 - DNA, 23 bp, Artificial Sequence
  Synthetic nucleic acid molecule
agcatcgtgtttgaaagtgaggc

SEQ ID NO: 7018 - DNA, 24 bp, Artificial Sequence
  Synthetic nucleic acid molecule
agcatggtcaggttctagtgaggg

SEQ ID NO: 7019 - DNA, 23 bp, Artificial Sequence
  Synthetic nucleic acid molecule
agcaacttcaggggaagtgaggg

SEQ ID NO: 7020 - DNA, 24 bp, Artificial Sequence
  Synthetic nucleic acid molecule
agcatggtcagattatagtgaggg

SEQ ID NO: 7021 - DNA, 24 bp, Artificial Sequence
  Synthetic nucleic acid molecule
agcatggtccgtgtctagtgaggg

SEQ ID NO: 7022 - DNA, 24 bp, Artificial Sequence
  Synthetic nucleic acid molecule
agcaaggtcacctgagagtgagag

SEQ ID NO: 7023 - DNA, 24 bp, Artificial Sequence
  Synthetic nucleic acid molecule
agcatggtcaagttctagtgaggg

SEQ ID NO: 7024 - DNA, 23 bp, Artificial Sequence
  Synthetic nucleic acid molecule
agcagggtataggggagtgagat

SEQ ID NO: 7025 - DNA, 24 bp, Artificial Sequence
  Synthetic nucleic acid molecule
ggcagagtccaagcagagtgagag

SEQ ID NO: 7026 - DNA, 24 bp, Artificial Sequence
  Synthetic nucleic acid molecule
agtaacgtcaaaggtgagtgaaaa

SEQ ID NO: 7027 - DNA, 24 bp, Artificial Sequence
  Synthetic nucleic acid molecule
agcatggtcaatttctagtgaggg

SEQ ID NO: 7028 - DNA, 23 bp, Artificial Sequence
  Synthetic nucleic acid molecule
agcagtgtggagtggagtgagag

SEQ ID NO: 7029 - DNA, 23 bp, Artificial Sequence
  Synthetic nucleic acid molecule
agcaccatccccatgagtgagtc

SEQ ID NO: 7030 - DNA, 24 bp, Artificial Sequence
  Synthetic nucleic acid molecule
agcaacgtgagacagtagtgagaa

SEQ ID NO: 7031 - DNA, 24 bp, Artificial Sequence
  Synthetic nucleic acid molecule
agcaacggccctgggcagtgaggg

SEQ ID NO: 7032 - DNA, 23 bp, Artificial Sequence
  Synthetic nucleic acid molecule
agtagagtcatggagagtgagag

SEQ ID NO: 7033 - DNA, 23 bp, Artificial Sequence
  Synthetic nucleic acid molecule
ggcaccgtcgctgagagtgagtc

SEQ ID NO: 7034 - DNA, 24 bp, Artificial Sequence
  Synthetic nucleic acid molecule
agcatggtcaggttctagtgaggg

SEQ ID NO: 7035 - DNA, 24 bp, Artificial Sequence
  Synthetic nucleic acid molecule
agcatagtcaggttctagtgaggg

SEQ ID NO: 7036 - DNA, 23 bp, Artificial Sequence
  Synthetic nucleic acid molecule
agtaacgtctccctgagtgtggg

SEQ ID NO: 7037 - DNA, 23 bp, Artificial Sequence
  Synthetic nucleic acid molecule
agcatagtggttaggagtgaggg

SEQ ID NO: 7038 - DNA, 23 bp, Artificial Sequence
  Synthetic nucleic acid molecule
atcagggtgggtaggagtgaggc

SEQ ID NO: 7039 - DNA, 23 bp, Artificial Sequence
  Synthetic nucleic acid molecule
tacagagtctccaggagtgaggg

SEQ ID NO: 7040 - DNA, 23 bp, Artificial Sequence
  Synthetic nucleic acid molecule
atgagggtctcatagagtgaggt

SEQ ID NO: 7041 - DNA, 23 bp, Artificial Sequence
  Synthetic nucleic acid molecule
agcaaattcttcaggagtgaggt

SEQ ID NO: 7042 - DNA, 24 bp, Artificial Sequence
  Synthetic nucleic acid molecule
agcaaagtgctcaaagagtgaggc

SEQ ID NO: 7043 - DNA, 24 bp, Artificial Sequence
  Synthetic nucleic acid molecule
ataagtgtcattgaagagtgaggc

SEQ ID NO: 7044 - DNA, 23 bp, Artificial Sequence
  Synthetic nucleic acid molecule
agtagtctcttgatgagtgaggg

SEQ ID NO: 7045 - DNA, 24 bp, Artificial Sequence
  Synthetic nucleic acid molecule
cgcagcaacagcggtgagtgaggg

SEQ ID NO: 7046 - DNA, 23 bp, Artificial Sequence
  Synthetic nucleic acid molecule
agcaatgtgtgcttgagtgaggc

SEQ ID NO: 7047 - DNA, 24 bp, Artificial Sequence
  Synthetic nucleic acid molecule
accaaagtctttgatgagtgaggg

SEQ ID NO: 7048 - DNA, 24 bp, Artificial Sequence
  Synthetic nucleic acid molecule
agtagtgtttcaagagagtgaggc

SEQ ID NO: 7049 - DNA, 24 bp, Artificial Sequence
  Synthetic nucleic acid molecule
agcatagtggggtaggagtgaggg

SEQ ID NO: 7050 - DNA, 24 bp, Artificial Sequence
  Synthetic nucleic acid molecule
atcaccatcctaagtgagtgaggg

SEQ ID NO: 7051 - DNA, 23 bp, Artificial Sequence
  Synthetic nucleic acid molecule
agaatcgtttgaaagagtgaggg

SEQ ID NO: 7052 - DNA, 24 bp, Artificial Sequence
  Synthetic nucleic acid molecule
agtaacatcggaaaagagtgaggt

SEQ ID NO: 7053 - DNA, 23 bp, Artificial Sequence
  Synthetic nucleic acid molecule
aggacagtcagttggagtgaggt

SEQ ID NO: 7054 - DNA, 23 bp, Artificial Sequence
  Synthetic nucleic acid molecule
ggcagtgttgacaggagtgaggc

SEQ ID NO: 7055 - DNA, 23 bp, Artificial Sequence
  Synthetic nucleic acid molecule
agttgtgtcgttttgagtgaggt

SEQ ID NO: 7056 - DNA, 24 bp, Artificial Sequence
  Synthetic nucleic acid molecule
cccaccgtcccgcccgagtgaggg

SEQ ID NO: 7057 - DNA, 24 bp, Artificial Sequence
  Synthetic nucleic acid molecule
agtaccggcttcacagagtgaggt

SEQ ID NO: 7058 - DNA, 24 bp, Artificial Sequence
  Synthetic nucleic acid molecule
agcaactttggaatggagtgaggg

SEQ ID NO: 7059 - DNA, 23 bp, Artificial Sequence
  Synthetic nucleic acid molecule
agcaagggcagtgagagtgaggc

SEQ ID NO: 7060 - DNA, 24 bp, Artificial Sequence
  Synthetic nucleic acid molecule
gtcagggtcataagagagtgaggc

SEQ ID NO: 7061 - DNA, 23 bp, Artificial Sequence
  Synthetic nucleic acid molecule
aggaaagtctaacagagtgaggt

SEQ ID NO: 7062 - DNA, 23 bp, Artificial Sequence
  Synthetic nucleic acid molecule
cacagtgtcaggctgagtgaggt

SEQ ID NO: 7063 - DNA, 24 bp, Artificial Sequence
  Synthetic nucleic acid molecule
gtcagtgtccaagaagagtgaggt

SEQ ID NO: 7064 - DNA, 24 bp, Artificial Sequence
  Synthetic nucleic acid molecule
atcaccatccagagagagtgaggg

SEQ ID NO: 7065 - DNA, 23 bp, Artificial Sequence
  Synthetic nucleic acid molecule
atcaacatctttgggagtgaggc

SEQ ID NO: 7066 - DNA, 23 bp, Artificial Sequence
  Synthetic nucleic acid molecule
ccgagcgtctgaaagagtgaggt

SEQ ID NO: 7067 - DNA, 24 bp, Artificial Sequence
  Synthetic nucleic acid molecule
agcacagtgagcactgagtgaggg

SEQ ID NO: 7068 - DNA, 23 bp, Artificial Sequence
  Synthetic nucleic acid molecule
aacattgtctaagggagtgaggt

SEQ ID NO: 7069 - DNA, 23 bp, Artificial Sequence
  Synthetic nucleic acid molecule
aacattgtctaagggagtgaggt

SEQ ID NO: 7070 - DNA, 23 bp, Artificial Sequence
  Synthetic nucleic acid molecule
aacattgtctaagggagtgaggt

SEQ ID NO: 7071 - DNA, 24 bp, Artificial Sequence
  Synthetic nucleic acid molecule
agtaccggcatccatgagtgaggt

SEQ ID NO: 7072 - DNA, 24 bp, Artificial Sequence
  Synthetic nucleic acid molecule
agtacagtctctgttgagtgagaa

SEQ ID NO: 7073 - DNA, 23 bp, Artificial Sequence
  Synthetic nucleic acid molecule
aacaacatcacggggagtgaggt

SEQ ID NO: 7074 - DNA, 24 bp, Artificial Sequence
  Synthetic nucleic acid molecule
tcccgcgtccgggaagagtgaggt

SEQ ID NO: 7075 - DNA, 24 bp, Artificial Sequence
  Synthetic nucleic acid molecule
aggggagtcagatgcgagtgaggg

SEQ ID NO: 7076 - DNA, 23 bp, Artificial Sequence
  Synthetic nucleic acid molecule
agtagctgcggccagagtgaggc

SEQ ID NO: 7077 - DNA, 23 bp, Artificial Sequence
  Synthetic nucleic acid molecule
ggaagggtcagtgcgagtgaggg

SEQ ID NO: 7078 - DNA, 23 bp, Artificial Sequence
  Synthetic nucleic acid molecule
ggaagggtcagtgcgagtgaggg

SEQ ID NO: 7079 - DNA, 23 bp, Artificial Sequence
  Synthetic nucleic acid molecule
ggaagggtcagtgcgagtgaggg

SEQ ID NO: 7080 - DNA, 23 bp, Artificial Sequence
  Synthetic nucleic acid molecule
ggaagggtcagtgcgagtgaggg

SEQ ID NO: 7081 - DNA, 23 bp, Artificial Sequence
  Synthetic nucleic acid molecule
ggaagggtcagtgcgagtgaggg

SEQ ID NO: 7082 - DNA, 23 bp, Artificial Sequence
  Synthetic nucleic acid molecule
ggaagggtcagtgcgagtgaggg

SEQ ID NO: 7083 - DNA, 23 bp, Artificial Sequence
  Synthetic nucleic acid molecule
ctcagtgtctcccagagtgaggc

SEQ ID NO: 7084 - DNA, 23 bp, Artificial Sequence
  Synthetic nucleic acid molecule
agtaaagtcacaaggagtgaggt

SEQ ID NO: 7085 - DNA, 23 bp, Artificial Sequence
  Synthetic nucleic acid molecule
aacggggtctgggagagtgaggt

SEQ ID NO: 7086 - DNA, 23 bp, Artificial Sequence
  Synthetic nucleic acid molecule
gggagggtccccatgagtgaggg

SEQ ID NO: 7087 - DNA, 24 bp, Artificial Sequence
  Synthetic nucleic acid molecule
ggcagggttaagattgagtgaggc

SEQ ID NO: 7088 - DNA, 24 bp, Artificial Sequence
  Synthetic nucleic acid molecule
aggggagtctgaggggagtgaggg

SEQ ID NO: 7089 - DNA, 23 bp, Artificial Sequence
  Synthetic nucleic acid molecule
aacaatgtcatgttgagtgaggg

SEQ ID NO: 7090 - DNA, 23 bp, Artificial Sequence
  Synthetic nucleic acid molecule
agcttggtctggctgagtgaggt

SEQ ID NO: 7091 - DNA, 23 bp, Artificial Sequence
  Synthetic nucleic acid molecule
atgagggtctcatagagtgaggt

SEQ ID NO: 7092 - DNA, 24 bp, Artificial Sequence
  Synthetic nucleic acid molecule
gccagtgtctcttaggagtgaggt

SEQ ID NO: 7093 - DNA, 23 bp, Artificial Sequence
  Synthetic nucleic acid molecule
atcacagtctctgggagtgaggc

SEQ ID NO: 7094 - DNA, 23 bp, Artificial Sequence
  Synthetic nucleic acid molecule
gacagggtcttaatgagtgaggc

SEQ ID NO: 7095 - DNA, 24 bp, Artificial Sequence
  Synthetic nucleic acid molecule
agccttgtcgtaactgagtgaggt

SEQ ID NO: 7096 - DNA, 23 bp, Artificial Sequence
  Synthetic nucleic acid molecule
ggcagcggtgttcagagtgaggg

SEQ ID NO: 7097 - DNA, 23 bp, Artificial Sequence
  Synthetic nucleic acid molecule
tccagtgtctatgggagtgaggc

SEQ ID NO: 7098 - DNA, 23 bp, Artificial Sequence
  Synthetic nucleic acid molecule
agcagctgtgatgtgagtgaggg

SEQ ID NO: 7099 - DNA, 23 bp, Artificial Sequence
  Synthetic nucleic acid molecule
agcagctcacatgggagtgaggt

SEQ ID NO: 7100 - DNA, 23 bp, Artificial Sequence
  Synthetic nucleic acid molecule
ggcaacggcacacagagggagga

SEQ ID NO: 7101 - DNA, 23 bp, Artificial Sequence
  Synthetic nucleic acid molecule
agctgagttaagcagagtgaggt

SEQ ID NO: 7102 - DNA, 24 bp, Artificial Sequence
  Synthetic nucleic acid molecule
agcagcacaaagctggagtgaggg

SEQ ID NO: 7103 - DNA, 23 bp, Artificial Sequence
  Synthetic nucleic acid molecule
agcaaccttgagatgagtgaggc

SEQ ID NO: 7104 - DNA, 24 bp, Artificial Sequence
  Synthetic nucleic acid molecule
agcaaattcgggcccgagtgaggt

SEQ ID NO: 7105 - DNA, 23 bp, Artificial Sequence
  Synthetic nucleic acid molecule
agacgggtcggcccgagtgaggt

SEQ ID NO: 7106 - DNA, 24 bp, Artificial Sequence
  Synthetic nucleic acid molecule
gccagagtctgcacagagtgaggg

SEQ ID NO: 7107 - DNA, 24 bp, Artificial Sequence
  Synthetic nucleic acid molecule
agcaacagcatttgggagtgaggg

SEQ ID NO: 7108 - DNA, 24 bp, Artificial Sequence
  Synthetic nucleic acid molecule
aaccgagtcactcaagagtgaggg

SEQ ID NO: 7109 - DNA, 24 bp, Artificial Sequence
  Synthetic nucleic acid molecule
agcagctcaccagcagagtgaggt

SEQ ID NO: 7110 - DNA, 24 bp, Artificial Sequence
  Synthetic nucleic acid molecule
ggaagggtcctgtgtgagtgaggg

SEQ ID NO: 7111 - DNA, 23 bp, Artificial Sequence
  Synthetic nucleic acid molecule
agaacggtccagcagagtgaggc

SEQ ID NO: 7112 - DNA, 23 bp, Artificial Sequence
  Synthetic nucleic acid molecule
agcaaggtaaggaaaagtgagga

SEQ ID NO: 7113 - DNA, 24 bp, Artificial Sequence
  Synthetic nucleic acid molecule
agaatggtcagtggggagtgaggg

SEQ ID NO: 7114 - DNA, 23 bp, Artificial Sequence
  Synthetic nucleic acid molecule
agaatggtccaaatgagtgaggg

SEQ ID NO: 7115 - DNA, 23 bp, Artificial Sequence
  Synthetic nucleic acid molecule
agcaagggctccgtgagtgaggg

SEQ ID NO: 7116 - DNA, 24 bp, Artificial Sequence
  Synthetic nucleic acid molecule
tgctgagtctccatggagtgaggg

SEQ ID NO: 7117 - DNA, 24 bp, Artificial Sequence
  Synthetic nucleic acid molecule
agcattgtttctggggagtgaggg

SEQ ID NO: 7118 - DNA, 23 bp, Artificial Sequence
  Synthetic nucleic acid molecule
agcattgtggtgaggagtgaggg

SEQ ID NO: 7119 - DNA, 23 bp, Artificial Sequence
  Synthetic nucleic acid molecule
gctagcgtccatgggagtgaggc

SEQ ID NO: 7120 - DNA, 24 bp, Artificial Sequence
  Synthetic nucleic acid molecule
agcaactttccactggagtgaggc

SEQ ID NO: 7121 - DNA, 23 bp, Artificial Sequence
  Synthetic nucleic acid molecule
agtagggttggtgggagtgaggg

SEQ ID NO: 7122 - DNA, 24 bp, Artificial Sequence
  Synthetic nucleic acid molecule
ggcagtgtttcccaggagtgaggc

SEQ ID NO: 7123 - DNA, 23 bp, Artificial Sequence
  Synthetic nucleic acid molecule
aactgagtctctgggagtgaggt

SEQ ID NO: 7124 - DNA, 23 bp, Artificial Sequence
  Synthetic nucleic acid molecule
agcattgtgatgaggagtgaggg

SEQ ID NO: 7125 - DNA, 23 bp, Artificial Sequence
  Synthetic nucleic acid molecule
agcaaggtttatgtgagtgagca

SEQ ID NO: 7126 - DNA, 23 bp, Artificial Sequence
  Synthetic nucleic acid molecule
ggcaacgtttgtatgagtgaggt

SEQ ID NO: 7127 - DNA, 24 bp, Artificial Sequence
  Synthetic nucleic acid molecule
aacaacctcgcctatgagtgaggg

SEQ ID NO: 7128 - DNA, 23 bp, Artificial Sequence
  Synthetic nucleic acid molecule
agggacgtccaagggagtgaggg

SEQ ID NO: 7129 - DNA, 24 bp, Artificial Sequence
  Synthetic nucleic acid molecule
tccagtgtcacatcagagtgaggc

SEQ ID NO: 7130 - DNA, 24 bp, Artificial Sequence
  Synthetic nucleic acid molecule
agcatggttggagtagagtgaggg

SEQ ID NO: 7131 - DNA, 23 bp, Artificial Sequence
  Synthetic nucleic acid molecule
aatagggtcaaaatgagtgaggt

SEQ ID NO: 7132 - DNA, 24 bp, Artificial Sequence
  Synthetic nucleic acid molecule
agtatagtctttagggagtgaggc

SEQ ID NO: 7133 - DNA, 23 bp, Artificial Sequence
  Synthetic nucleic acid molecule
tgcaatgtccttgggagtgaggc

SEQ ID NO: 7134 - DNA, 24 bp, Artificial Sequence
  Synthetic nucleic acid molecule
agctacatctacagggagtgaggg

SEQ ID NO: 7135 - DNA, 24 bp, Artificial Sequence
  Synthetic nucleic acid molecule
agcaaagtaaagagagagtgaggc

SEQ ID NO: 7136 - DNA, 24 bp, Artificial Sequence
  Synthetic nucleic acid molecule
caccccgtctacctggagtgagga

SEQ ID NO: 7137 - DNA, 23 bp, Artificial Sequence
  Synthetic nucleic acid molecule
aggcacgttaggcagagtgagga

SEQ ID NO: 7138 - DNA, 24 bp, Artificial Sequence
  Synthetic nucleic acid molecule
caccccgtcgacgtcgagtgagga

SEQ ID NO: 7139 - DNA, 23 bp, Artificial Sequence
  Synthetic nucleic acid molecule
gcaagagtctggctgagtgagga

SEQ ID NO: 7140 - DNA, 23 bp, Artificial Sequence
  Synthetic nucleic acid molecule
agtgcagtcccttagagtgagga

SEQ ID NO: 7141 - DNA, 24 bp, Artificial Sequence
  Synthetic nucleic acid molecule
atccacgttatgctggagtgagga

SEQ ID NO: 7142 - DNA, 23 bp, Artificial Sequence
  Synthetic nucleic acid molecule
atccacgttttggggagtgagga

SEQ ID NO: 7143 - DNA, 24 bp, Artificial Sequence
  Synthetic nucleic acid molecule
agcagcttctgccatgagtgaagt

SEQ ID NO: 7144 - DNA, 24 bp, Artificial Sequence
  Synthetic nucleic acid molecule
agcagggtctgcagtgagagaggc

SEQ ID NO: 7145 - DNA, 23 bp, Artificial Sequence
  Synthetic nucleic acid molecule
agcagcttccaggagagtgaagt

SEQ ID NO: 7146 - DNA, 24 bp, Artificial Sequence
  Synthetic nucleic acid molecule
agcagggtctgttttgagtgagtt

SEQ ID NO: 7147 - DNA, 23 bp, Artificial Sequence
  Synthetic nucleic acid molecule
agcaactgcattttgagtgaggg

SEQ ID NO: 7148 - DNA, 23 bp, Artificial Sequence
  Synthetic nucleic acid molecule
agcaactgcatcttgagtgaggg

SEQ ID NO: 7149 - DNA, 24 bp, Artificial Sequence
  Synthetic nucleic acid molecule
agcagcttcccaaaaatgtgagga

SEQ ID NO: 7150 - DNA, 24 bp, Artificial Sequence
  Synthetic nucleic acid molecule
aggtgcctccccatggagtgagga

SEQ ID NO: 7151 - DNA, 23 bp, Artificial Sequence
  Synthetic nucleic acid molecule
agctcagtccacaggagtgagtc

SEQ ID NO: 7152 - DNA, 23 bp, Artificial Sequence
  Synthetic nucleic acid molecule
agcagcgtgcagaagagagagga

SEQ ID NO: 7153 - DNA, 24 bp, Artificial Sequence
  Synthetic nucleic acid molecule
agcagcgtggatggagagagagga

SEQ ID NO: 7154 - DNA, 24 bp, Artificial Sequence
  Synthetic nucleic acid molecule
agcagcgtggatggagagagagga

SEQ ID NO: 7155 - DNA, 24 bp, Artificial Sequence
  Synthetic nucleic acid molecule
agcagcgtggatggagagagagga

SEQ ID NO: 7156 - DNA, 24 bp, Artificial Sequence
  Synthetic nucleic acid molecule
agcagcctctgccaggggtgagga

SEQ ID NO: 7157 - DNA, 23 bp, Artificial Sequence
  Synthetic nucleic acid molecule
agcagcctcccatagagggagga

SEQ ID NO: 7158 - DNA, 24 bp, Artificial Sequence
  Synthetic nucleic acid molecule
aggagcgtcccttgggagtgatga

SEQ ID NO: 7159 - DNA, 23 bp, Artificial Sequence
  Synthetic nucleic acid molecule
agcagcgacagccagagtgacga

SEQ ID NO: 7160 - DNA, 23 bp, Artificial Sequence
  Synthetic nucleic acid molecule
agctgcgtcctgtagcgtgagga

SEQ ID NO: 7161 - DNA, 23 bp, Artificial Sequence
  Synthetic nucleic acid molecule
agcagggtctgcctgagtcagga

SEQ ID NO: 7162 - DNA, 23 bp, Artificial Sequence
  Synthetic nucleic acid molecule
agcagcatctgggagaatgagga

SEQ ID NO: 7163 - DNA, 24 bp, Artificial Sequence
  Synthetic nucleic acid molecule
aggagcgtccagtgcgactgagga

SEQ ID NO: 7164 - DNA, 24 bp, Artificial Sequence
  Synthetic nucleic acid molecule
agcagcgtggatggagagagagga

SEQ ID NO: 7165 - DNA, 24 bp, Artificial Sequence
  Synthetic nucleic acid molecule
agcagcgtggatggagagagagga

SEQ ID NO: 7166 - DNA, 24 bp, Artificial Sequence
  Synthetic nucleic acid molecule
agcagcatcacagacgcgtgagga

SEQ ID NO: 7167 - DNA, 24 bp, Artificial Sequence
  Synthetic nucleic acid molecule
accagcgtctgctttgggtgagga

SEQ ID NO: 7168 - DNA, 23 bp, Artificial Sequence
  Synthetic nucleic acid molecule
agcagggtcattgagaatgagga

SEQ ID NO: 7169 - DNA, 23 bp, Artificial Sequence
  Synthetic nucleic acid molecule
aggagcgacggggggagtgagga

SEQ ID NO: 7170 - DNA, 23 bp, Artificial Sequence
  Synthetic nucleic acid molecule
aggagcgacggggggagtgagga

SEQ ID NO: 7171 - DNA, 23 bp, Artificial Sequence
  Synthetic nucleic acid molecule
aggagcgacggggggagtgagga

SEQ ID NO: 7172 - DNA, 23 bp, Artificial Sequence
  Synthetic nucleic acid molecule
aggagcgacggggggagtgagga

SEQ ID NO: 7173 - DNA, 23 bp, Artificial Sequence
  Synthetic nucleic acid molecule
aggagcgacggggggagtgagga

SEQ ID NO: 7174 - DNA, 23 bp, Artificial Sequence
  Synthetic nucleic acid molecule
aggagcgacggggggagtgagga

SEQ ID NO: 7175 - DNA, 23 bp, Artificial Sequence
  Synthetic nucleic acid molecule
aggagcgacggggggagtgagga

SEQ ID NO: 7176 - DNA, 23 bp, Artificial Sequence
  Synthetic nucleic acid molecule
aggagcgacggggggagtgagga

SEQ ID NO: 7177 - DNA, 23 bp, Artificial Sequence
  Synthetic nucleic acid molecule
aggagcgacggggggagtgagga

SEQ ID NO: 7178 - DNA, 23 bp, Artificial Sequence
  Synthetic nucleic acid molecule
aggagcgacggggggagtgagga

SEQ ID NO: 7179 - DNA, 23 bp, Artificial Sequence
  Synthetic nucleic acid molecule
aggagcgacggggggagtgagga

SEQ ID NO: 7180 - DNA, 23 bp, Artificial Sequence
  Synthetic nucleic acid molecule
aggagcgacggggggagtgagga

SEQ ID NO: 7181 - DNA, 23 bp, Artificial Sequence
  Synthetic nucleic acid molecule
aggagcgacggggggagtgagga

SEQ ID NO: 7182 - DNA, 23 bp, Artificial Sequence
  Synthetic nucleic acid molecule
aggagcgacggggggagtgagga

SEQ ID NO: 7183 - DNA, 23 bp, Artificial Sequence
  Synthetic nucleic acid molecule
aggagcgacggggggagtgagga

SEQ ID NO: 7184 - DNA, 23 bp, Artificial Sequence
  Synthetic nucleic acid molecule
aggagcgacggggggagtgagga

SEQ ID NO: 7185 - DNA, 23 bp, Artificial Sequence
  Synthetic nucleic acid molecule
aggagcgacggggggagtgagga

SEQ ID NO: 7186 - DNA, 23 bp, Artificial Sequence
  Synthetic nucleic acid molecule
aggagcgacggggggagtgagga

SEQ ID NO: 7187 - DNA, 23 bp, Artificial Sequence
  Synthetic nucleic acid molecule
aggagcgacggggggagtgagga

SEQ ID NO: 7188 - DNA, 23 bp, Artificial Sequence
  Synthetic nucleic acid molecule
aggagcgacggggggagtgagga

SEQ ID NO: 7189 - DNA, 23 bp, Artificial Sequence
  Synthetic nucleic acid molecule
aggagcgacggggggagtgagga

SEQ ID NO: 7190 - DNA, 23 bp, Artificial Sequence
  Synthetic nucleic acid molecule
aggagcgacggggggagtgagga

SEQ ID NO: 7191 - DNA, 23 bp, Artificial Sequence
  Synthetic nucleic acid molecule
aggagcgacggggggagtgagga

SEQ ID NO: 7192 - DNA, 23 bp, Artificial Sequence
  Synthetic nucleic acid molecule
aggagcgacggggggagtgagga

SEQ ID NO: 7193 - DNA, 23 bp, Artificial Sequence
  Synthetic nucleic acid molecule
aggagcgacggggggagtgagga

SEQ ID NO: 7194 - DNA, 23 bp, Artificial Sequence
  Synthetic nucleic acid molecule
aggagcgacggggggagtgagga

SEQ ID NO: 7195 - DNA, 23 bp, Artificial Sequence
  Synthetic nucleic acid molecule
aggagcgacggggggagtgagga

SEQ ID NO: 7196 - DNA, 23 bp, Artificial Sequence
  Synthetic nucleic acid molecule
aggagcgacggggggagtgagga

SEQ ID NO: 7197 - DNA, 23 bp, Artificial Sequence
  Synthetic nucleic acid molecule
aggagcgacggggggagtgagga

SEQ ID NO: 7198 - DNA, 23 bp, Artificial Sequence
  Synthetic nucleic acid molecule
aggagcgacggggggagtgagga

SEQ ID NO: 7199 - DNA, 23 bp, Artificial Sequence
  Synthetic nucleic acid molecule
aggagcgacggggggagtgagga

SEQ ID NO: 7200 - DNA, 23 bp, Artificial Sequence
  Synthetic nucleic acid molecule
aggagcgacggggggagtgagga

SEQ ID NO: 7201 - DNA, 23 bp, Artificial Sequence
  Synthetic nucleic acid molecule
aggagcgacggggggagtgagga

SEQ ID NO: 7202 - DNA, 23 bp, Artificial Sequence
  Synthetic nucleic acid molecule
aggagcgacggggggagtgagga

SEQ ID NO: 7203 - DNA, 23 bp, Artificial Sequence
  Synthetic nucleic acid molecule
aacagcctccttccgagtgagga

SEQ ID NO: 7204 - DNA, 24 bp, Artificial Sequence
  Synthetic nucleic acid molecule
agaagcatccgaagggagtgagga

SEQ ID NO: 7205 - DNA, 24 bp, Artificial Sequence
  Synthetic nucleic acid molecule
agaagcctccattccgagtgagga

SEQ ID NO: 7206 - DNA, 23 bp, Artificial Sequence
  Synthetic nucleic acid molecule
agcagcgtcaggggaaattagga

SEQ ID NO: 7207 - DNA, 24 bp, Artificial Sequence
  Synthetic nucleic acid molecule
agcagcgtcttggaagaccgaggt

SEQ ID NO: 7208 - DNA, 23 bp, Artificial Sequence
  Synthetic nucleic acid molecule
agcagcgtcctgtggcgtggcga

SEQ ID NO: 7209 - DNA, 24 bp, Artificial Sequence
  Synthetic nucleic acid molecule
agcagcgtctcagcgggtggagga

SEQ ID NO: 7210 - DNA, 24 bp, Artificial Sequence
  Synthetic nucleic acid molecule
agcagcgtccgccgagagtcagcc

SEQ ID NO: 7211 - DNA, 24 bp, Artificial Sequence
  Synthetic nucleic acid molecule
agcagcgtcagggagaagtcaggt

SEQ ID NO: 7212 - DNA, 24 bp, Artificial Sequence
  Synthetic nucleic acid molecule
agcagcgtcaacagtgcctgatga

SEQ ID NO: 7213 - DNA, 24 bp, Artificial Sequence
  Synthetic nucleic acid molecule
agcagcgtcagtagagacagagaa

SEQ ID NO: 7214 - DNA, 24 bp, Artificial Sequence
  Synthetic nucleic acid molecule
agcagcgtcgggtgggtttgggga

SEQ ID NO: 7215 - DNA, 24 bp, Artificial Sequence
  Synthetic nucleic acid molecule
agcagcgtctccgaagagacagca

SEQ ID NO: 7216 - DNA, 23 bp, Artificial Sequence
  Synthetic nucleic acid molecule
agcagcgtcccgaggagctggga

SEQ ID NO: 7217 - DNA, 23 bp, Artificial Sequence
  Synthetic nucleic acid molecule
agcagcgtccggccgcggcagga

SEQ ID NO: 7218 - DNA, 23 bp, Artificial Sequence
  Synthetic nucleic acid molecule
agcagcgtccggccgcggcagga

SEQ ID NO: 7219 - DNA, 24 bp, Artificial Sequence
  Synthetic nucleic acid molecule
agcagcgtcactcccaagcgagta

SEQ ID NO: 7220 - DNA, 23 bp, Artificial Sequence
  Synthetic nucleic acid molecule
agcagcgtcccctgcagagagca

SEQ ID NO: 7221 - DNA, 24 bp, Artificial Sequence
  Synthetic nucleic acid molecule
agcagcgtctctctgggctgggga

SEQ ID NO: 7222 - DNA, 24 bp, Artificial Sequence
  Synthetic nucleic acid molecule
agcagcgtccaggagggctgggga

SEQ ID NO: 7223 - DNA, 24 bp, Artificial Sequence
  Synthetic nucleic acid molecule
agcagcgtcagggtggagtcatgt

SEQ ID NO: 7224 - DNA, 24 bp, Artificial Sequence
  Synthetic nucleic acid molecule
agcagcgtctgattggcgggggga

SEQ ID NO: 7225 - DNA, 23 bp, Artificial Sequence
  Synthetic nucleic acid molecule
agcagcgtctggggaattgggga

SEQ ID NO: 7226 - DNA, 24 bp, Artificial Sequence
  Synthetic nucleic acid molecule
agcagcgtccgccgagagtcagcc

SEQ ID NO: 7227 - DNA, 23 bp, Artificial Sequence
  Synthetic nucleic acid molecule
agcagtgtcagttggcgggagga

SEQ ID NO: 7228 - DNA, 24 bp, Artificial Sequence
  Synthetic nucleic acid molecule
agcagagtccaaaaggggtgaggc

SEQ ID NO: 7229 - DNA, 23 bp, Artificial Sequence
  Synthetic nucleic acid molecule
atcagcgtccagaggagtgaaca

SEQ ID NO: 7230 - DNA, 24 bp, Artificial Sequence
  Synthetic nucleic acid molecule
agcagagtctcagaggagtgaagc

SEQ ID NO: 7231 - DNA, 24 bp, Artificial Sequence
  Synthetic nucleic acid molecule
aacagcgtcctgggagagtgtgca

SEQ ID NO: 7232 - DNA, 23 bp, Artificial Sequence
  Synthetic nucleic acid molecule
tgcagcgtcttctttagtgagca

SEQ ID NO: 7233 - DNA, 24 bp, Artificial Sequence
  Synthetic nucleic acid molecule
agcagcttccaacaatagtaagga

SEQ ID NO: 7234 - DNA, 24 bp, Artificial Sequence
  Synthetic nucleic acid molecule
agcagtgtcccctataagtgagaa

SEQ ID NO: 7235 - DNA, 23 bp, Artificial Sequence
  Synthetic nucleic acid molecule
agcagcatcaatctgagtgtggg

SEQ ID NO: 7236 - DNA, 23 bp, Artificial Sequence
  Synthetic nucleic acid molecule
agcagtgtcaacatcagtgagaa

SEQ ID NO: 7237 - DNA, 23 bp, Artificial Sequence
  Synthetic nucleic acid molecule
agcagcttctcccagggtgaggc

SEQ ID NO: 7238 - DNA, 23 bp, Artificial Sequence
  Synthetic nucleic acid molecule
agcagagtcaggcagggtgaggc

SEQ ID NO: 7239 - DNA, 24 bp, Artificial Sequence
  Synthetic nucleic acid molecule
agcagggtctgcagggagtgtggt

SEQ ID NO: 7240 - DNA, 23 bp, Artificial Sequence
  Synthetic nucleic acid molecule
agctgcgtcctctagagggaggg

SEQ ID NO: 7241 - DNA, 23 bp, Artificial Sequence
  Synthetic nucleic acid molecule
agcagcgtacctgggtgtgagaa

SEQ ID NO: 7242 - DNA, 24 bp, Artificial Sequence
  Synthetic nucleic acid molecule
agcagcctcagaaataggtgagga

SEQ ID NO: 7243 - DNA, 23 bp, Artificial Sequence
  Synthetic nucleic acid molecule
agcagcgttcctctcagtgatga

SEQ ID NO: 7244 - DNA, 24 bp, Artificial Sequence
  Synthetic nucleic acid molecule
agcagcctctggagggagggaggg

SEQ ID NO: 7245 - DNA, 24 bp, Artificial Sequence
  Synthetic nucleic acid molecule
agcagtgtcagatggtggtgagga

SEQ ID NO: 7246 - DNA, 24 bp, Artificial Sequence
  Synthetic nucleic acid molecule
agcagtgtcttgttaaagtgaaga

SEQ ID NO: 7247 - DNA, 24 bp, Artificial Sequence
  Synthetic nucleic acid molecule
agcagcatctgggtagagtgaagg

SEQ ID NO: 7248 - DNA, 23 bp, Artificial Sequence
  Synthetic nucleic acid molecule
agcagcatcctcctgggtaagga

SEQ ID NO: 7249 - DNA, 23 bp, Artificial Sequence
  Synthetic nucleic acid molecule
agcagggtccctctgagtggggc

SEQ ID NO: 7250 - DNA, 24 bp, Artificial Sequence
  Synthetic nucleic acid molecule
atcagcgtctttcttgagtgataa

SEQ ID NO: 7251 - DNA, 23 bp, Artificial Sequence
  Synthetic nucleic acid molecule
agcagcatcctcctgggtaagga

SEQ ID NO: 7252 - DNA, 23 bp, Artificial Sequence
  Synthetic nucleic acid molecule
agcagcatcctcctgggtaagga

SEQ ID NO: 7253 - DNA, 23 bp, Artificial Sequence
  Synthetic nucleic acid molecule
agcagcatcctcctgggtaagga

SEQ ID NO: 7254 - DNA, 23 bp, Artificial Sequence
  Synthetic nucleic acid molecule
agcagcatcctcctgggtaagga

SEQ ID NO: 7255 - DNA, 24 bp, Artificial Sequence
  Synthetic nucleic acid molecule
agcagtgtcttaggggaatgaggc

SEQ ID NO: 7256 - DNA, 24 bp, Artificial Sequence
  Synthetic nucleic acid molecule
agcagcttccaggcagagggagaa

SEQ ID NO: 7257 - DNA, 24 bp, Artificial Sequence
  Synthetic nucleic acid molecule
agcagcgtgctgcgagagtgtgaa

SEQ ID NO: 7258 - DNA, 23 bp, Artificial Sequence
  Synthetic nucleic acid molecule
agtagcgtccttgggattgaaga

SEQ ID NO: 7259 - DNA, 24 bp, Artificial Sequence
  Synthetic nucleic acid molecule
agcagcttccagactgagggagaa

SEQ ID NO: 7260 - DNA, 23 bp, Artificial Sequence
  Synthetic nucleic acid molecule
agcagcgtggaggagagagaggc

SEQ ID NO: 7261 - DNA, 23 bp, Artificial Sequence
  Synthetic nucleic acid molecule
atcagcgtcatccagaaggagga

SEQ ID NO: 7262 - DNA, 24 bp, Artificial Sequence
  Synthetic nucleic acid molecule
agcagcatcaaagaggagagaggg

SEQ ID NO: 7263 - DNA, 24 bp, Artificial Sequence
  Synthetic nucleic acid molecule
agcagtgtcttccatgagtgggta

SEQ ID NO: 7264 - DNA, 23 bp, Artificial Sequence
  Synthetic nucleic acid molecule
agcagcgactgtagaaatgagga

SEQ ID NO: 7265 - DNA, 24 bp, Artificial Sequence
  Synthetic nucleic acid molecule
agcagtgtcgatacatggtgagga

SEQ ID NO: 7266 - DNA, 23 bp, Artificial Sequence
  Synthetic nucleic acid molecule
agcagcgtggagaggaggaagga

SEQ ID NO: 7267 - DNA, 23 bp, Artificial Sequence
  Synthetic nucleic acid molecule
agcagcttcactgtgactgaaga

SEQ ID NO: 7268 - DNA, 23 bp, Artificial Sequence
  Synthetic nucleic acid molecule
agcagagtcctcttttgtgagga

SEQ ID NO: 7269 - DNA, 23 bp, Artificial Sequence
  Synthetic nucleic acid molecule
agcagcttctccagcagtgatga

SEQ ID NO: 7270 - DNA, 23 bp, Artificial Sequence
  Synthetic nucleic acid molecule
agcagtgtcatactaagggagga

SEQ ID NO: 7271 - DNA, 23 bp, Artificial Sequence
  Synthetic nucleic acid molecule
agccgcgtctccaagagtcagta

SEQ ID NO: 7272 - DNA, 24 bp, Artificial Sequence
  Synthetic nucleic acid molecule
tgcagcgtcaaattggagtaaggg

SEQ ID NO: 7273 - DNA, 24 bp, Artificial Sequence
  Synthetic nucleic acid molecule
agcagcatcagaggtgtgtgagaa

SEQ ID NO: 7274 - DNA, 24 bp, Artificial Sequence
  Synthetic nucleic acid molecule
agcagcgtgttcatggagtgcggc

SEQ ID NO: 7275 - DNA, 23 bp, Artificial Sequence
  Synthetic nucleic acid molecule
agcagtgtcctttgcagtgagaa

SEQ ID NO: 7276 - DNA, 23 bp, Artificial Sequence
  Synthetic nucleic acid molecule
agcagcgcctctcagagtgaaca

SEQ ID NO: 7277 - DNA, 23 bp, Artificial Sequence
  Synthetic nucleic acid molecule
agcagcatcttgggaactgagga

SEQ ID NO: 7278 - DNA, 24 bp, Artificial Sequence
  Synthetic nucleic acid molecule
agcagcctctttttggagggaggg

SEQ ID NO: 7279 - DNA, 23 bp, Artificial Sequence
  Synthetic nucleic acid molecule
ggcagcgtcgcagggagtgggaa

SEQ ID NO: 7280 - DNA, 24 bp, Artificial Sequence
  Synthetic nucleic acid molecule
agcagcctcggaaacaagtgaggg

SEQ ID NO: 7281 - DNA, 24 bp, Artificial Sequence
  Synthetic nucleic acid molecule
agcagagtctgatatgagtgagct

SEQ ID NO: 7282 - DNA, 23 bp, Artificial Sequence
  Synthetic nucleic acid molecule
tgcagcgtcagcatgagtggggc

SEQ ID NO: 7283 - DNA, 24 bp, Artificial Sequence
  Synthetic nucleic acid molecule
agcagggtctggagggagacagga

SEQ ID NO: 7284 - DNA, 24 bp, Artificial Sequence
  Synthetic nucleic acid molecule
agcagagtcacgagagaatgggga

SEQ ID NO: 7285 - DNA, 23 bp, Artificial Sequence
  Synthetic nucleic acid molecule
agcagggtcctgcagggtgaggc

SEQ ID NO: 7286 - DNA, 24 bp, Artificial Sequence
  Synthetic nucleic acid molecule
agcagcctcagggatgagggaggt

SEQ ID NO: 7287 - DNA, 23 bp, Artificial Sequence
  Synthetic nucleic acid molecule
agcagcggcatcgggggcgagga

SEQ ID NO: 7288 - DNA, 24 bp, Artificial Sequence
  Synthetic nucleic acid molecule
agcagggtcatcacagagggaaga

SEQ ID NO: 7289 - DNA, 24 bp, Artificial Sequence
  Synthetic nucleic acid molecule
agcagtgtctggtgtgagggagca

SEQ ID NO: 7290 - DNA, 24 bp, Artificial Sequence
  Synthetic nucleic acid molecule
agcagcggctggggggaggcagga

SEQ ID NO: 7291 - DNA, 24 bp, Artificial Sequence
  Synthetic nucleic acid molecule
agcagcatccctggagagggagaa

SEQ ID NO: 7292 - DNA, 24 bp, Artificial Sequence
  Synthetic nucleic acid molecule
agcagggtcggtgtctggtgagga

SEQ ID NO: 7293 - DNA, 23 bp, Artificial Sequence
  Synthetic nucleic acid molecule
agcagggtccaggtaagagagga

SEQ ID NO: 7294 - DNA, 24 bp, Artificial Sequence
  Synthetic nucleic acid molecule
agcagtgtcatctctgagtggaga

SEQ ID NO: 7295 - DNA, 24 bp, Artificial Sequence
  Synthetic nucleic acid molecule
agcagcctccgtctagagggaggt

SEQ ID NO: 7296 - DNA, 24 bp, Artificial Sequence
  Synthetic nucleic acid molecule
agcagcgccagcctcaagtgaggg

SEQ ID NO: 7297 - DNA, 23 bp, Artificial Sequence
  Synthetic nucleic acid molecule
agcagcgacattgtgagtaagca

SEQ ID NO: 7298 - DNA, 23 bp, Artificial Sequence
  Synthetic nucleic acid molecule
agcagcttccggtgtagtgatga

SEQ ID NO: 7299 - DNA, 24 bp, Artificial Sequence
  Synthetic nucleic acid molecule
agcagggtcccagcagagaaagga

SEQ ID NO: 7300 - DNA, 23 bp, Artificial Sequence
  Synthetic nucleic acid molecule
agcagcgactccgggagtgcaga

SEQ ID NO: 7301 - DNA, 23 bp, Artificial Sequence
  Synthetic nucleic acid molecule
agcagcgtgggaaagaggaagga

SEQ ID NO: 7302 - DNA, 24 bp, Artificial Sequence
  Synthetic nucleic acid molecule
ggcagcgtctatggagaatgagaa

SEQ ID NO: 7303 - DNA, 24 bp, Artificial Sequence
  Synthetic nucleic acid molecule
agcagcctccacactgagggaggt

SEQ ID NO: 7304 - DNA, 24 bp, Artificial Sequence
  Synthetic nucleic acid molecule
agcagcctccctcttgtgtgaggg

SEQ ID NO: 7305 - DNA, 23 bp, Artificial Sequence
  Synthetic nucleic acid molecule
tgcagcgtcgctgaaagtgagaa

SEQ ID NO: 7306 - DNA, 24 bp, Artificial Sequence
  Synthetic nucleic acid molecule
agcagtgtcttgtatgactgaggt

SEQ ID NO: 7307 - DNA, 24 bp, Artificial Sequence
  Synthetic nucleic acid molecule
agcaacgtcagcaaagtgtcagga

SEQ ID NO: 7308 - DNA, 23 bp, Artificial Sequence
  Synthetic nucleic acid molecule
agcagcatcagcaggagtgtgaa

SEQ ID NO: 7309 - DNA, 23 bp, Artificial Sequence
  Synthetic nucleic acid molecule
agcagcctcattgggagtgagtg

SEQ ID NO: 7310 - DNA, 24 bp, Artificial Sequence
  Synthetic nucleic acid molecule
agcagggtcttggatgagttaaga

SEQ ID NO: 7311 - DNA, 23 bp, Artificial Sequence
  Synthetic nucleic acid molecule
agcagcggcagactgagcgagca

SEQ ID NO: 7312 - DNA, 24 bp, Artificial Sequence
  Synthetic nucleic acid molecule
agcagggtcctgttggagacagga

SEQ ID NO: 7313 - DNA, 23 bp, Artificial Sequence
  Synthetic nucleic acid molecule
agcagcatcagcatcagttagga

SEQ ID NO: 7314 - DNA, 24 bp, Artificial Sequence
  Synthetic nucleic acid molecule
agcagagtcagaaatgagtgaagc

SEQ ID NO: 7315 - DNA, 24 bp, Artificial Sequence
  Synthetic nucleic acid molecule
agcagcgcccacccttggtgagga

SEQ ID NO: 7316 - DNA, 23 bp, Artificial Sequence
  Synthetic nucleic acid molecule
agcagcggctgatggaggcagga

SEQ ID NO: 7317 - DNA, 24 bp, Artificial Sequence
  Synthetic nucleic acid molecule
agcagcctcgctttgaggtgagga

SEQ ID NO: 7318 - DNA, 24 bp, Artificial Sequence
  Synthetic nucleic acid molecule
agcatcgtcatcctagagtcagca

SEQ ID NO: 7319 - DNA, 23 bp, Artificial Sequence
  Synthetic nucleic acid molecule
ggcagcgtcgggcagagggagaa

SEQ ID NO: 7320 - DNA, 23 bp, Artificial Sequence
  Synthetic nucleic acid molecule
agcagcctcatcctgtgagagga

SEQ ID NO: 7321 - DNA, 24 bp, Artificial Sequence
  Synthetic nucleic acid molecule
agcagtgtcttccatgagtgggta

SEQ ID NO: 7322 - DNA, 24 bp, Artificial Sequence
  Synthetic nucleic acid molecule
ggcagcgtccaatctcagtgagaa

SEQ ID NO: 7323 - DNA, 24 bp, Artificial Sequence
  Synthetic nucleic acid molecule
agcagtgtcacctctgagtgggta

SEQ ID NO: 7324 - DNA, 24 bp, Artificial Sequence
  Synthetic nucleic acid molecule
agcagcatctatagcgactgaggt

SEQ ID NO: 7325 - DNA, 24 bp, Artificial Sequence
  Synthetic nucleic acid molecule
agcagtgtctggtttgggggagga

SEQ ID NO: 7326 - DNA, 23 bp, Artificial Sequence
  Synthetic nucleic acid molecule
agcagagtcggagtgagagaggg

SEQ ID NO: 7327 - DNA, 23 bp, Artificial Sequence
  Synthetic nucleic acid molecule
agtagcgtctaggcaagtgagca

SEQ ID NO: 7328 - DNA, 23 bp, Artificial Sequence
  Synthetic nucleic acid molecule
agcagcctctacatgagtgagac

SEQ ID NO: 7329 - DNA, 23 bp, Artificial Sequence
  Synthetic nucleic acid molecule
agcagtgtcaataagagagtgga

SEQ ID NO: 7330 - DNA, 23 bp, Artificial Sequence
  Synthetic nucleic acid molecule
agcagcgtttctcaaagtgcgga

SEQ ID NO: 7331 - DNA, 23 bp, Artificial Sequence
  Synthetic nucleic acid molecule
agcagcgactgtgaaagtgagaa

SEQ ID NO: 7332 - DNA, 23 bp, Artificial Sequence
  Synthetic nucleic acid molecule
agcagagtccctgtgagtgaagg

SEQ ID NO: 7333 - DNA, 23 bp, Artificial Sequence
  Synthetic nucleic acid molecule
ggcagcgtcctttccagcgagga

SEQ ID NO: 7334 - DNA, 24 bp, Artificial Sequence
  Synthetic nucleic acid molecule
agcagggtcaatgtctggtgagga

SEQ ID NO: 7335 - DNA, 23 bp, Artificial Sequence
  Synthetic nucleic acid molecule
agcagcatcaggctgagtgtggt

SEQ ID NO: 7336 - DNA, 23 bp, Artificial Sequence
  Synthetic nucleic acid molecule
agcagtgtctcgttaggtgagga

SEQ ID NO: 7337 - DNA, 24 bp, Artificial Sequence
  Synthetic nucleic acid molecule
agcagggtcagcaaagaatgaggc

SEQ ID NO: 7338 - DNA, 23 bp, Artificial Sequence
  Synthetic nucleic acid molecule
agcagagtcacaaagaatgagta

SEQ ID NO: 7339 - DNA, 24 bp, Artificial Sequence
  Synthetic nucleic acid molecule
agcagcgtggggctggagggagaa

SEQ ID NO: 7340 - DNA, 24 bp, Artificial Sequence
  Synthetic nucleic acid molecule
agcagcgtgttcatggagtgcggc

SEQ ID NO: 7341 - DNA, 24 bp, Artificial Sequence
  Synthetic nucleic acid molecule
agcagcatctaacaggagggaggg

SEQ ID NO: 7342 - DNA, 23 bp, Artificial Sequence
  Synthetic nucleic acid molecule
agcagcctcctagggagggaggg

SEQ ID NO: 7343 - DNA, 23 bp, Artificial Sequence
  Synthetic nucleic acid molecule
agcagcttctgagctagtgaaga

SEQ ID NO: 7344 - DNA, 24 bp, Artificial Sequence
  Synthetic nucleic acid molecule
atcagcgtctactaagagagtgga

SEQ ID NO: 7345 - DNA, 24 bp, Artificial Sequence
  Synthetic nucleic acid molecule
agcagcatcacctgcgagggaggg

SEQ ID NO: 7346 - DNA, 23 bp, Artificial Sequence
  Synthetic nucleic acid molecule
agcagcatcgagttgggtgaggt

SEQ ID NO: 7347 - DNA, 24 bp, Artificial Sequence
  Synthetic nucleic acid molecule
tgcagcgtccaagctcagtgaggc

SEQ ID NO: 7348 - DNA, 23 bp, Artificial Sequence
  Synthetic nucleic acid molecule
agcagcttcattttgaatgaggg

SEQ ID NO: 7349 - DNA, 24 bp, Artificial Sequence
  Synthetic nucleic acid molecule
agcagcctcttttgggagtggggg

SEQ ID NO: 7350 - DNA, 23 bp, Artificial Sequence
  Synthetic nucleic acid molecule
agcagcgcctcccagagtggggc

SEQ ID NO: 7351 - DNA, 23 bp, Artificial Sequence
  Synthetic nucleic acid molecule
agcagggtcccccagagaaagga

SEQ ID NO: 7352 - DNA, 23 bp, Artificial Sequence
  Synthetic nucleic acid molecule
agcagcctcccggagagggaggg

SEQ ID NO: 7353 - DNA, 24 bp, Artificial Sequence
  Synthetic nucleic acid molecule
ggcagcgtcgggtgggagagagaa

SEQ ID NO: 7354 - DNA, 24 bp, Artificial Sequence
  Synthetic nucleic acid molecule
agcagagtctaccttgagtgaaaa

SEQ ID NO: 7355 - DNA, 23 bp, Artificial Sequence
  Synthetic nucleic acid molecule
agcagcgacccaaggagtaagaa

SEQ ID NO: 7356 - DNA, 24 bp, Artificial Sequence
  Synthetic nucleic acid molecule
agcagtgtctttagaaagtgagca

SEQ ID NO: 7357 - DNA, 23 bp, Artificial Sequence
  Synthetic nucleic acid molecule
agcagggtcgggcctggtgagga

SEQ ID NO: 7358 - DNA, 24 bp, Artificial Sequence
  Synthetic nucleic acid molecule
agcagcggctgaatcctgtgagga

SEQ ID NO: 7359 - DNA, 24 bp, Artificial Sequence
  Synthetic nucleic acid molecule
tgcagcgtctggcatgagtggggc

SEQ ID NO: 7360 - DNA, 23 bp, Artificial Sequence
  Synthetic nucleic acid molecule
agaagcgtcatgctgagtgaaaa

SEQ ID NO: 7361 - DNA, 24 bp, Artificial Sequence
  Synthetic nucleic acid molecule
agcagggtccagggagagggaaga

SEQ ID NO: 7362 - DNA, 23 bp, Artificial Sequence
  Synthetic nucleic acid molecule
agcagcatccctgtgagtgagtg

SEQ ID NO: 7363 - DNA, 24 bp, Artificial Sequence
  Synthetic nucleic acid molecule
agtagcgtcaatgataagtgtgga

SEQ ID NO: 7364 - DNA, 23 bp, Artificial Sequence
  Synthetic nucleic acid molecule
agcagggtccaggtaagagagga

SEQ ID NO: 7365 - DNA, 23 bp, Artificial Sequence
  Synthetic nucleic acid molecule
agcagggtccaggtaagagagga

SEQ ID NO: 7366 - DNA, 23 bp, Artificial Sequence
  Synthetic nucleic acid molecule
agcagggtccaggtaagagagga

SEQ ID NO: 7367 - DNA, 24 bp, Artificial Sequence
  Synthetic nucleic acid molecule
agcaacctcaccccagagagagga

SEQ ID NO: 7368 - DNA, 24 bp, Artificial Sequence
  Synthetic nucleic acid molecule
agcaacgtgtgttgggagagagga

SEQ ID NO: 7369 - DNA, 24 bp, Artificial Sequence
  Synthetic nucleic acid molecule
atcagggtcaggttttagtgagga

SEQ ID NO: 7370 - DNA, 23 bp, Artificial Sequence
  Synthetic nucleic acid molecule
agcaaagtctgtatgagtgagca

SEQ ID NO: 7371 - DNA, 24 bp, Artificial Sequence
  Synthetic nucleic acid molecule
agcagtgtaaaggagtagtgagga

SEQ ID NO: 7372 - DNA, 24 bp, Artificial Sequence
  Synthetic nucleic acid molecule
agcagagtaaagcaggtgtgagga

SEQ ID NO: 7373 - DNA, 23 bp, Artificial Sequence
  Synthetic nucleic acid molecule
agcagcctgggagagagtgaggg

SEQ ID NO: 7374 - DNA, 24 bp, Artificial Sequence
  Synthetic nucleic acid molecule
agcaacctcctgggtgagagagga

SEQ ID NO: 7375 - DNA, 24 bp, Artificial Sequence
  Synthetic nucleic acid molecule
aacagcttcagtacacagtgagga

SEQ ID NO: 7376 - DNA, 24 bp, Artificial Sequence
  Synthetic nucleic acid molecule
agtagtgtcaatgaagagtgaaga

SEQ ID NO: 7377 - DNA, 24 bp, Artificial Sequence
  Synthetic nucleic acid molecule
atcagggtctagggagagtgtgga

SEQ ID NO: 7378 - DNA, 23 bp, Artificial Sequence
  Synthetic nucleic acid molecule
ggcagggtccccgggagggagga

SEQ ID NO: 7379 - DNA, 24 bp, Artificial Sequence
  Synthetic nucleic acid molecule
agctgggtctgaagggtgtgagga

SEQ ID NO: 7380 - DNA, 23 bp, Artificial Sequence
  Synthetic nucleic acid molecule
agctgggtcctcaggagagagga

SEQ ID NO: 7381 - DNA, 24 bp, Artificial Sequence
  Synthetic nucleic acid molecule
agcagctccagggccgagtgagaa

SEQ ID NO: 7382 - DNA, 24 bp, Artificial Sequence
  Synthetic nucleic acid molecule
agcaacatccgctctgagtgggga

SEQ ID NO: 7383 - DNA, 23 bp, Artificial Sequence
  Synthetic nucleic acid molecule
aacagcttcacaggcagtgagga

SEQ ID NO: 7384 - DNA, 24 bp, Artificial Sequence
  Synthetic nucleic acid molecule
atcagcgcccaacaccagtgagga

SEQ ID NO: 7385 - DNA, 23 bp, Artificial Sequence
  Synthetic nucleic acid molecule
agcaggggcagtgggagtgagta

SEQ ID NO: 7386 - DNA, 23 bp, Artificial Sequence
  Synthetic nucleic acid molecule
agcatggtctggttgggtgagga

SEQ ID NO: 7387 - DNA, 24 bp, Artificial Sequence
  Synthetic nucleic acid molecule
ggcagcgtgctctgagagagagga

SEQ ID NO: 7388 - DNA, 23 bp, Artificial Sequence
  Synthetic nucleic acid molecule
agcagagccccctggagtgaggg

SEQ ID NO: 7389 - DNA, 24 bp, Artificial Sequence
  Synthetic nucleic acid molecule
agcaccgtgcttcaaaagtgagga

SEQ ID NO: 7390 - DNA, 23 bp, Artificial Sequence
  Synthetic nucleic acid molecule
cccagcgtcagcaggagtcagga

SEQ ID NO: 7391 - DNA, 24 bp, Artificial Sequence
  Synthetic nucleic acid molecule
aggagcgtggacacagagtgaggt

SEQ ID NO: 7392 - DNA, 24 bp, Artificial Sequence
  Synthetic nucleic acid molecule
agccgagtctgtcccgagtgtgga

SEQ ID NO: 7393 - DNA, 24 bp, Artificial Sequence
  Synthetic nucleic acid molecule
agtagagtctctgttgagtgagta

SEQ ID NO: 7394 - DNA, 23 bp, Artificial Sequence
  Synthetic nucleic acid molecule
accagggtcatggcaagtgagga

SEQ ID NO: 7395 - DNA, 24 bp, Artificial Sequence
  Synthetic nucleic acid molecule
tgcagggtcagattgaagtgagga

SEQ ID NO: 7396 - DNA, 24 bp, Artificial Sequence
  Synthetic nucleic acid molecule
agcagcggggagagagagcgagga

SEQ ID NO: 7397 - DNA, 23 bp, Artificial Sequence
  Synthetic nucleic acid molecule
tgcagcgccgaggtgagtgaggg

SEQ ID NO: 7398 - DNA, 23 bp, Artificial Sequence
  Synthetic nucleic acid molecule
agtagagtctggctgagggagga

SEQ ID NO: 7399 - DNA, 23 bp, Artificial Sequence
  Synthetic nucleic acid molecule
tgcagcgccgaggtgagtgaggg

SEQ ID NO: 7400 - DNA, 24 bp, Artificial Sequence
  Synthetic nucleic acid molecule
agtagggtcacactagagtgaaga

SEQ ID NO: 7401 - DNA, 23 bp, Artificial Sequence
  Synthetic nucleic acid molecule
tgcagcgccgaggtgagtgaggg

SEQ ID NO: 7402 - DNA, 23 bp, Artificial Sequence
  Synthetic nucleic acid molecule
tgcagcgccgaggtgagtgaggg

SEQ ID NO: 7403 - DNA, 23 bp, Artificial Sequence
  Synthetic nucleic acid molecule
tgcagcgccgaggtgagtgaggg

SEQ ID NO: 7404 - DNA, 23 bp, Artificial Sequence
  Synthetic nucleic acid molecule
tgcagcgccgaggtgagtgaggg

SEQ ID NO: 7405 - DNA, 23 bp, Artificial Sequence
  Synthetic nucleic acid molecule
tgcagcgccgaggtgagtgaggg

SEQ ID NO: 7406 - DNA, 23 bp, Artificial Sequence
  Synthetic nucleic acid molecule
tgcagcgccgaggtgagtgaggg

SEQ ID NO: 7407 - DNA, 24 bp, Artificial Sequence
  Synthetic nucleic acid molecule
agcagggtaaagcaagagtgagaa

SEQ ID NO: 7408 - DNA, 24 bp, Artificial Sequence
  Synthetic nucleic acid molecule
agcagcggggaccgggagcgagga

SEQ ID NO: 7409 - DNA, 24 bp, Artificial Sequence
  Synthetic nucleic acid molecule
agcaggttcagtgtctagtgagga

SEQ ID NO: 7410 - DNA, 24 bp, Artificial Sequence
  Synthetic nucleic acid molecule
ggcatcgtctgcagtaagtgagga

SEQ ID NO: 7411 - DNA, 24 bp, Artificial Sequence
  Synthetic nucleic acid molecule
aatagcgtcagccccaagtgagga

SEQ ID NO: 7412 - DNA, 23 bp, Artificial Sequence
  Synthetic nucleic acid molecule
agcagcatggtatggagggagga

SEQ ID NO: 7413 - DNA, 23 bp, Artificial Sequence
  Synthetic nucleic acid molecule
agcagcctgctgcagagtgaggg

SEQ ID NO: 7414 - DNA, 23 bp, Artificial Sequence
  Synthetic nucleic acid molecule
ggcagcgtggtggtgagagagga

SEQ ID NO: 7415 - DNA, 24 bp, Artificial Sequence
  Synthetic nucleic acid molecule
agcagagttggtgtctagtgagga

SEQ ID NO: 7416 - DNA, 23 bp, Artificial Sequence
  Synthetic nucleic acid molecule
aacagagtcgggaagagtaagga

SEQ ID NO: 7417 - DNA, 23 bp, Artificial Sequence
  Synthetic nucleic acid molecule
aacagcggcgtcctgagtgtgga

SEQ ID NO: 7418 - DNA, 23 bp, Artificial Sequence
  Synthetic nucleic acid molecule
agcagggtgtgagagagggagga

SEQ ID NO: 7419 - DNA, 23 bp, Artificial Sequence
  Synthetic nucleic acid molecule
agctgcatcaaacttagtgagga

SEQ ID NO: 7420 - DNA, 23 bp, Artificial Sequence
  Synthetic nucleic acid molecule
ggcagggtctcccggagggagga

SEQ ID NO: 7421 - DNA, 23 bp, Artificial Sequence
  Synthetic nucleic acid molecule
agcagcttttcagagagtgaaga

SEQ ID NO: 7422 - DNA, 23 bp, Artificial Sequence
  Synthetic nucleic acid molecule
agcagggccctgctgagtgaggg

SEQ ID NO: 7423 - DNA, 23 bp, Artificial Sequence
  Synthetic nucleic acid molecule
agcagggccctgctgagtgaggg

SEQ ID NO: 7424 - DNA, 23 bp, Artificial Sequence
  Synthetic nucleic acid molecule
ggcagcgttgggatgtgtgagga

SEQ ID NO: 7425 - DNA, 23 bp, Artificial Sequence
  Synthetic nucleic acid molecule
aacagagtcacagtgagtaagga

SEQ ID NO: 7426 - DNA, 23 bp, Artificial Sequence
  Synthetic nucleic acid molecule
agcagggccgggcagagtgaggg

SEQ ID NO: 7427 - DNA, 23 bp, Artificial Sequence
  Synthetic nucleic acid molecule
gggagcgtctgccccagtgagga

SEQ ID NO: 7428 - DNA, 24 bp, Artificial Sequence
  Synthetic nucleic acid molecule
atcagtgtctaaaatgggtgagga

SEQ ID NO: 7429 - DNA, 23 bp, Artificial Sequence
  Synthetic nucleic acid molecule
agcggcttctgcctgagtgaggg

SEQ ID NO: 7430 - DNA, 24 bp, Artificial Sequence
  Synthetic nucleic acid molecule
agcaatgtctgccttgggtgagga

SEQ ID NO: 7431 - DNA, 23 bp, Artificial Sequence
  Synthetic nucleic acid molecule
agcaaagtcaccaggagtgagca

SEQ ID NO: 7432 - DNA, 24 bp, Artificial Sequence
  Synthetic nucleic acid molecule
agcaatgtcaatcaggagagagga

SEQ ID NO: 7433 - DNA, 23 bp, Artificial Sequence
  Synthetic nucleic acid molecule
agcagggtggaaaggaatgagga

SEQ ID NO: 7434 - DNA, 24 bp, Artificial Sequence
  Synthetic nucleic acid molecule
accagcctcctgagggagtgaggg

SEQ ID NO: 7435 - DNA, 23 bp, Artificial Sequence
  Synthetic nucleic acid molecule
agaagcggcgttgtaagtgagga

SEQ ID NO: 7436 - DNA, 23 bp, Artificial Sequence
  Synthetic nucleic acid molecule
agcagtgtggtagacagtgagga

SEQ ID NO: 7437 - DNA, 23 bp, Artificial Sequence
  Synthetic nucleic acid molecule
agcaatgtcagtctgagttagga

SEQ ID NO: 7438 - DNA, 24 bp, Artificial Sequence
  Synthetic nucleic acid molecule
agcagggtgttggaggaatgagga

SEQ ID NO: 7439 - DNA, 23 bp, Artificial Sequence
  Synthetic nucleic acid molecule
agcagcatggaaaagagggagga

SEQ ID NO: 7440 - DNA, 23 bp, Artificial Sequence
  Synthetic nucleic acid molecule
agcagctttgtagagagtgaaga

SEQ ID NO: 7441 - DNA, 23 bp, Artificial Sequence
  Synthetic nucleic acid molecule
agcaaggtctgggagagtcagga

SEQ ID NO: 7442 - DNA, 23 bp, Artificial Sequence
  Synthetic nucleic acid molecule
agcagcctgccaaggagtgaggg

SEQ ID NO: 7443 - DNA, 23 bp, Artificial Sequence
  Synthetic nucleic acid molecule
agcagtggctaagagagtgagca

SEQ ID NO: 7444 - DNA, 23 bp, Artificial Sequence
  Synthetic nucleic acid molecule
aacagcgtgtgtgaaagtgagga

SEQ ID NO: 7445 - DNA, 24 bp, Artificial Sequence
  Synthetic nucleic acid molecule
agcatcctctatgctgtgtgagga

SEQ ID NO: 7446 - DNA, 24 bp, Artificial Sequence
  Synthetic nucleic acid molecule
agcagagccatgaaggagtgaggc

SEQ ID NO: 7447 - DNA, 23 bp, Artificial Sequence
  Synthetic nucleic acid molecule
agcagccgcctgagcagtgagga

SEQ ID NO: 7448 - DNA, 23 bp, Artificial Sequence
  Synthetic nucleic acid molecule
agcagcgagggaggaagtgagga

SEQ ID NO: 7449 - DNA, 23 bp, Artificial Sequence
  Synthetic nucleic acid molecule
agccgggtcttccgaagtgagga

SEQ ID NO: 7450 - DNA, 24 bp, Artificial Sequence
  Synthetic nucleic acid molecule
agcctcgtccccagagagggagga

SEQ ID NO: 7451 - DNA, 24 bp, Artificial Sequence
  Synthetic nucleic acid molecule
aggagagtcccatgagagtgagaa

SEQ ID NO: 7452 - DNA, 24 bp, Artificial Sequence
  Synthetic nucleic acid molecule
agcaatgtcagataggggtgagga

SEQ ID NO: 7453 - DNA, 24 bp, Artificial Sequence
  Synthetic nucleic acid molecule
agcatcggcctctctgagtgacga

SEQ ID NO: 7454 - DNA, 23 bp, Artificial Sequence
  Synthetic nucleic acid molecule
agcatcttcagttgaagtgagga

SEQ ID NO: 7455 - DNA, 24 bp, Artificial Sequence
  Synthetic nucleic acid molecule
ggcagcgtgtatgatgagagagga

SEQ ID NO: 7456 - DNA, 24 bp, Artificial Sequence
  Synthetic nucleic acid molecule
agcagggtaaagagtgagtgagaa

SEQ ID NO: 7457 - DNA, 24 bp, Artificial Sequence
  Synthetic nucleic acid molecule
aacagagtcagcccttagtgagga

SEQ ID NO: 7458 - DNA, 23 bp, Artificial Sequence
  Synthetic nucleic acid molecule
agcacagtccggatgagtgagca

SEQ ID NO: 7459 - DNA, 24 bp, Artificial Sequence
  Synthetic nucleic acid molecule
attagcgtcacttagaagtgagga

SEQ ID NO: 7460 - DNA, 23 bp, Artificial Sequence
  Synthetic nucleic acid molecule
aacagagtcagagatagtgagga

SEQ ID NO: 7461 - DNA, 23 bp, Artificial Sequence
  Synthetic nucleic acid molecule
agcagcctggcatggagtgaggg

SEQ ID NO: 7462 - DNA, 24 bp, Artificial Sequence
  Synthetic nucleic acid molecule
aacaccgtcacctgtgggtgagga

SEQ ID NO: 7463 - DNA, 23 bp, Artificial Sequence
  Synthetic nucleic acid molecule
agcagcggaaataagggtgagga

SEQ ID NO: 7464 - DNA, 24 bp, Artificial Sequence
  Synthetic nucleic acid molecule
ggcagcgtgaacccagagtgagta

SEQ ID NO: 7465 - DNA, 24 bp, Artificial Sequence
  Synthetic nucleic acid molecule
aacaccgtcctgccagtgtgagga

SEQ ID NO: 7466 - DNA, 23 bp, Artificial Sequence
  Synthetic nucleic acid molecule
agcagcgatgttgtaagtgagga

SEQ ID NO: 7467 - DNA, 24 bp, Artificial Sequence
  Synthetic nucleic acid molecule
agcagggtgggaaaggagggagga

SEQ ID NO: 7468 - DNA, 24 bp, Artificial Sequence
  Synthetic nucleic acid molecule
agctgggtcagaggtgagagagga

SEQ ID NO: 7469 - DNA, 23 bp, Artificial Sequence
  Synthetic nucleic acid molecule
agcagctccagggagagtgagaa

SEQ ID NO: 7470 - DNA, 24 bp, Artificial Sequence
  Synthetic nucleic acid molecule
agcaatgtcttccttgggtgagga

SEQ ID NO: 7471 - DNA, 24 bp, Artificial Sequence
  Synthetic nucleic acid molecule
agcacagtctgaacagagtgagca

SEQ ID NO: 7472 - DNA, 24 bp, Artificial Sequence
  Synthetic nucleic acid molecule
agcagcggaggatctgggtgagga

SEQ ID NO: 7473 - DNA, 23 bp, Artificial Sequence
  Synthetic nucleic acid molecule
agcagcttttgggagagtgagca

SEQ ID NO: 7474 - DNA, 24 bp, Artificial Sequence
  Synthetic nucleic acid molecule
agcagcgatttgaagaagtgagga

SEQ ID NO: 7475 - DNA, 23 bp, Artificial Sequence
  Synthetic nucleic acid molecule
agcagcagcacaaagagtgagta

SEQ ID NO: 7476 - DNA, 24 bp, Artificial Sequence
  Synthetic nucleic acid molecule
aggagcggcaggtgatagtgagga

SEQ ID NO: 7477 - DNA, 23 bp, Artificial Sequence
  Synthetic nucleic acid molecule
agcacggtccaaaggagagagga

SEQ ID NO: 7478 - DNA, 24 bp, Artificial Sequence
  Synthetic nucleic acid molecule
agctgggtcattccccagtgagga

SEQ ID NO: 7479 - DNA, 24 bp, Artificial Sequence
  Synthetic nucleic acid molecule
agctgagtcagccaagtgtgagga

SEQ ID NO: 7480 - DNA, 24 bp, Artificial Sequence
  Synthetic nucleic acid molecule
agtagggtcaacgttgagtgaaga

SEQ ID NO: 7481 - DNA, 24 bp, Artificial Sequence
  Synthetic nucleic acid molecule
agtagagtcaacagtgagtgatga

SEQ ID NO: 7482 - DNA, 23 bp, Artificial Sequence
  Synthetic nucleic acid molecule
aggagagtcgctctgagtgagaa

SEQ ID NO: 7483 - DNA, 23 bp, Artificial Sequence
  Synthetic nucleic acid molecule
agcgccgtctctggaagtgagga

SEQ ID NO: 7484 - DNA, 24 bp, Artificial Sequence
  Synthetic nucleic acid molecule
agctgtgtccctcctgagggagga

SEQ ID NO: 7485 - DNA, 24 bp, Artificial Sequence
  Synthetic nucleic acid molecule
agctgcctccgtggggagtgaggc

SEQ ID NO: 7486 - DNA, 23 bp, Artificial Sequence
  Synthetic nucleic acid molecule
agcagcctgctgcagagtgaggg

SEQ ID NO: 7487 - DNA, 23 bp, Artificial Sequence
  Synthetic nucleic acid molecule
agcagcctgctgcagagtgaggg

SEQ ID NO: 7488 - DNA, 23 bp, Artificial Sequence
  Synthetic nucleic acid molecule
ggcagagtcgtgcatagtgagga

SEQ ID NO: 7489 - DNA, 24 bp, Artificial Sequence
  Synthetic nucleic acid molecule
agcattgtcaatattgactgagga

SEQ ID NO: 7490 - DNA, 23 bp, Artificial Sequence
  Synthetic nucleic acid molecule
agcagggtgggtaagagtgagaa

SEQ ID NO: 7491 - DNA, 23 bp, Artificial Sequence
  Synthetic nucleic acid molecule
ggcagggtctctgggagggagga

SEQ ID NO: 7492 - DNA, 23 bp, Artificial Sequence
  Synthetic nucleic acid molecule
agtagagtccagtagagtgatga

SEQ ID NO: 7493 - DNA, 23 bp, Artificial Sequence
  Synthetic nucleic acid molecule
agcagggccctgctgagtgaggg

SEQ ID NO: 7494 - DNA, 23 bp, Artificial Sequence
  Synthetic nucleic acid molecule
agcaaagtctttaggagagagga

SEQ ID NO: 7495 - DNA, 23 bp, Artificial Sequence
  Synthetic nucleic acid molecule
agcagtgccctgaagagtgagaa

SEQ ID NO: 7496 - DNA, 24 bp, Artificial Sequence
  Synthetic nucleic acid molecule
ggcagggtccgagcccagtgagga

SEQ ID NO: 7497 - DNA, 23 bp, Artificial Sequence
  Synthetic nucleic acid molecule
agctgggtctggctgagtgtgga

SEQ ID NO: 7498 - DNA, 23 bp, Artificial Sequence
  Synthetic nucleic acid molecule
agcagctttcatggaagtgagga

SEQ ID NO: 7499 - DNA, 23 bp, Artificial Sequence
  Synthetic nucleic acid molecule
atcatcgtcatcgtgagagagga

SEQ ID NO: 7500 - DNA, 23 bp, Artificial Sequence
  Synthetic nucleic acid molecule
agccgcgtgagggcaagtgagga

SEQ ID NO: 7501 - DNA, 24 bp, Artificial Sequence
  Synthetic nucleic acid molecule
agcagggtgggcaaggagggagga

SEQ ID NO: 7502 - DNA, 24 bp, Artificial Sequence
  Synthetic nucleic acid molecule
agcatggtcaagtttgggtgagga

SEQ ID NO: 7503 - DNA, 23 bp, Artificial Sequence
  Synthetic nucleic acid molecule
atcagagtcagagaaagtgagga

SEQ ID NO: 7504 - DNA, 23 bp, Artificial Sequence
  Synthetic nucleic acid molecule
agcagtggcagaataagtgagga

SEQ ID NO: 7505 - DNA, 23 bp, Artificial Sequence
  Synthetic nucleic acid molecule
aggagtgtctgcaaaagtgagga

SEQ ID NO: 7506 - DNA, 23 bp, Artificial Sequence
  Synthetic nucleic acid molecule
tgcagggtcaagccaagtgagga

SEQ ID NO: 7507 - DNA, 24 bp, Artificial Sequence
  Synthetic nucleic acid molecule
agcaggttcagtgtctagtgagga

SEQ ID NO: 7508 - DNA, 23 bp, Artificial Sequence
  Synthetic nucleic acid molecule
agcagcggaaataagggtgagga

SEQ ID NO: 7509 - DNA, 23 bp, Artificial Sequence
  Synthetic nucleic acid molecule
agcagggtgctcgggagggagga

SEQ ID NO: 7510 - DNA, 24 bp, Artificial Sequence
  Synthetic nucleic acid molecule
agcaacctccccacagagggagga

SEQ ID NO: 7511 - DNA, 23 bp, Artificial Sequence
  Synthetic nucleic acid molecule
agcagggtgggggagagggagga

SEQ ID NO: 7512 - DNA, 24 bp, Artificial Sequence
  Synthetic nucleic acid molecule
agcaacctctgctcagagagagga

SEQ ID NO: 7513 - DNA, 23 bp, Artificial Sequence
  Synthetic nucleic acid molecule
tgcagggtctgcggaagtgagga

SEQ ID NO: 7514 - DNA, 24 bp, Artificial Sequence
  Synthetic nucleic acid molecule
agcaggttcagactgaagtgagga

SEQ ID NO: 7515 - DNA, 23 bp, Artificial Sequence
  Synthetic nucleic acid molecule
agcaatgtcaccatgagtgtgga

SEQ ID NO: 7516 - DNA, 24 bp, Artificial Sequence
  Synthetic nucleic acid molecule
agcacggtccccaaggagggagga

SEQ ID NO: 7517 - DNA, 23 bp, Artificial Sequence
  Synthetic nucleic acid molecule
agcagcgctcgggcgagcgagga

SEQ ID NO: 7518 - DNA, 24 bp, Artificial Sequence
  Synthetic nucleic acid molecule
agcagggactggtcagagtgaggt

SEQ ID NO: 7519 - DNA, 24 bp, Artificial Sequence
  Synthetic nucleic acid molecule
agcagccacacaatccagtgagga

SEQ ID NO: 7520 - DNA, 24 bp, Artificial Sequence
  Synthetic nucleic acid molecule
agtagagtcaagagggagtgagta

SEQ ID NO: 7521 - DNA, 23 bp, Artificial Sequence
  Synthetic nucleic acid molecule
agcctcgtcttggtgagggagga

SEQ ID NO: 7522 - DNA, 24 bp, Artificial Sequence
  Synthetic nucleic acid molecule
ggcagcggcctggaggggtgagga

SEQ ID NO: 7523 - DNA, 24 bp, Artificial Sequence
  Synthetic nucleic acid molecule
agcagagttggtttctagtgagga

SEQ ID NO: 7524 - DNA, 23 bp, Artificial Sequence
  Synthetic nucleic acid molecule
agcatcttcacctgaagtgagga

SEQ ID NO: 7525 - DNA, 23 bp, Artificial Sequence
  Synthetic nucleic acid molecule
agcaacatcataatgagtgggga

SEQ ID NO: 7526 - DNA, 23 bp, Artificial Sequence
  Synthetic nucleic acid molecule
agcacagtccctaagagtgagca

SEQ ID NO: 7527 - DNA, 23 bp, Artificial Sequence
  Synthetic nucleic acid molecule
aggagtttccagttgagtgagga

SEQ ID NO: 7528 - DNA, 23 bp, Artificial Sequence
  Synthetic nucleic acid molecule
ggcagcagccatcagagtgagga

SEQ ID NO: 7529 - DNA, 24 bp, Artificial Sequence
  Synthetic nucleic acid molecule
agcaggttgttggaggagtgagga

SEQ ID NO: 7530 - DNA, 23 bp, Artificial Sequence
  Synthetic nucleic acid molecule
aacagtgccctggtgagtgagga

SEQ ID NO: 7531 - DNA, 24 bp, Artificial Sequence
  Synthetic nucleic acid molecule
tggagcgtggggggagagtgagga

SEQ ID NO: 7532 - DNA, 24 bp, Artificial Sequence
  Synthetic nucleic acid molecule
tggagcgtggaagaggagtgagga

SEQ ID NO: 7533 - DNA, 23 bp, Artificial Sequence
  Synthetic nucleic acid molecule
agctgaggcacagggagtgagga

SEQ ID NO: 7534 - DNA, 24 bp, Artificial Sequence
  Synthetic nucleic acid molecule
tgcagggtggacccagagtgagga

SEQ ID NO: 7535 - DNA, 23 bp, Artificial Sequence
  Synthetic nucleic acid molecule
aacagagtgaggctgagtgagga

SEQ ID NO: 7536 - DNA, 23 bp, Artificial Sequence
  Synthetic nucleic acid molecule
agcaacttattgctgagtgagga

SEQ ID NO: 7537 - DNA, 24 bp, Artificial Sequence
  Synthetic nucleic acid molecule
agcacaatctttttggagtgagga

SEQ ID NO: 7538 - DNA, 24 bp, Artificial Sequence
  Synthetic nucleic acid molecule
tggagggtcggtggagagtgagga

SEQ ID NO: 7539 - DNA, 24 bp, Artificial Sequence
  Synthetic nucleic acid molecule
agccgtgtggctacggagtgagga

SEQ ID NO: 7540 - DNA, 24 bp, Artificial Sequence
  Synthetic nucleic acid molecule
tgctgcttctgccgtgagtgagga

SEQ ID NO: 7541 - DNA, 23 bp, Artificial Sequence
  Synthetic nucleic acid molecule
aacagagtaacacagagtgagga

SEQ ID NO: 7542 - DNA, 23 bp, Artificial Sequence
  Synthetic nucleic acid molecule
accaacttcatgtagagtgagga

SEQ ID NO: 7543 - DNA, 23 bp, Artificial Sequence
  Synthetic nucleic acid molecule
aggagagtgagtgtgagtgagga

SEQ ID NO: 7544 - DNA, 24 bp, Artificial Sequence
  Synthetic nucleic acid molecule
ggcagggtggcgaaggagtgagga

SEQ ID NO: 7545 - DNA, 24 bp, Artificial Sequence
  Synthetic nucleic acid molecule
ggcagggtggccggggagtgagga

SEQ ID NO: 7546 - DNA, 24 bp, Artificial Sequence
  Synthetic nucleic acid molecule
agcagggctcctggtgagtgagga

SEQ ID NO: 7547 - DNA, 24 bp, Artificial Sequence
  Synthetic nucleic acid molecule
tacagtgtcagcagtgagtgagga

SEQ ID NO: 7548 - DNA, 24 bp, Artificial Sequence
  Synthetic nucleic acid molecule
atcaccttctttcatgagtgagga

SEQ ID NO: 7549 - DNA, 24 bp, Artificial Sequence
  Synthetic nucleic acid molecule
ttcagtgtctgacgggagtgagga

SEQ ID NO: 7550 - DNA, 24 bp, Artificial Sequence
  Synthetic nucleic acid molecule
agcagctcaggttaggagtgagga

SEQ ID NO: 7551 - DNA, 23 bp, Artificial Sequence
  Synthetic nucleic acid molecule
aggagagtagggctgagtgagga

SEQ ID NO: 7552 - DNA, 24 bp, Artificial Sequence
  Synthetic nucleic acid molecule
acctgggtctgagcagagtgagga

SEQ ID NO: 7553 - DNA, 23 bp, Artificial Sequence
  Synthetic nucleic acid molecule
atcagtgtgtttttgagtgagga

SEQ ID NO: 7554 - DNA, 24 bp, Artificial Sequence
  Synthetic nucleic acid molecule
tggagggtcagaggagagtgagga

SEQ ID NO: 7555 - DNA, 23 bp, Artificial Sequence
  Synthetic nucleic acid molecule
ggcagggtgcgagggagtgagga

SEQ ID NO: 7556 - DNA, 23 bp, Artificial Sequence
  Synthetic nucleic acid molecule
aggagagtgaatgtgagtgagga

SEQ ID NO: 7557 - DNA, 23 bp, Artificial Sequence
  Synthetic nucleic acid molecule
agcagtgcacccaagagtgagga

SEQ ID NO: 7558 - DNA, 24 bp, Artificial Sequence
  Synthetic nucleic acid molecule
agcaggttgaagactgagtgagga

SEQ ID NO: 7559 - DNA, 24 bp, Artificial Sequence
  Synthetic nucleic acid molecule
aggagagtgagaagtgagtgagga

SEQ ID NO: 7560 - DNA, 24 bp, Artificial Sequence
  Synthetic nucleic acid molecule
agcagccgtaacaaagagtgagga

SEQ ID NO: 7561 - DNA, 23 bp, Artificial Sequence
  Synthetic nucleic acid molecule
agcagggcagggcagagtgagga

SEQ ID NO: 7562 - DNA, 23 bp, Artificial Sequence
  Synthetic nucleic acid molecule
gccagcctcaggctgagtgagga

SEQ ID NO: 7563 - DNA, 24 bp, Artificial Sequence
  Synthetic nucleic acid molecule
agcagggcttggtgggagtgagga

SEQ ID NO: 7564 - DNA, 23 bp, Artificial Sequence
  Synthetic nucleic acid molecule
agtagcaactattagagtgagga

SEQ ID NO: 7565 - DNA, 23 bp, Artificial Sequence
  Synthetic nucleic acid molecule
aacagcggagatttgagtgagga

SEQ ID NO: 7566 - DNA, 23 bp, Artificial Sequence
  Synthetic nucleic acid molecule
aggaccatccgagagagtgagga

SEQ ID NO: 7567 - DNA, 23 bp, Artificial Sequence
  Synthetic nucleic acid molecule
aggaccatcccagggagtgagga

SEQ ID NO: 7568 - DNA, 23 bp, Artificial Sequence
  Synthetic nucleic acid molecule
aggaccatcccagggagtgagga

SEQ ID NO: 7569 - DNA, 23 bp, Artificial Sequence
  Synthetic nucleic acid molecule
aggaccatcccagggagtgagga

SEQ ID NO: 7570 - DNA, 23 bp, Artificial Sequence
  Synthetic nucleic acid molecule
agcaggttaacagggagtgagga

SEQ ID NO: 7571 - DNA, 23 bp, Artificial Sequence
  Synthetic nucleic acid molecule
tgcagggtgagcctgagtgagga

SEQ ID NO: 7572 - DNA, 23 bp, Artificial Sequence
  Synthetic nucleic acid molecule
agaagggtagaaaggagtgagga

SEQ ID NO: 7573 - DNA, 23 bp, Artificial Sequence
  Synthetic nucleic acid molecule
agatgcggccagtagagtgagga

SEQ ID NO: 7574 - DNA, 24 bp, Artificial Sequence
  Synthetic nucleic acid molecule
aatagggtcaggtaggagtgagga

SEQ ID NO: 7575 - DNA, 23 bp, Artificial Sequence
  Synthetic nucleic acid molecule
agcagtgaaggtgggagtgagga

SEQ ID NO: 7576 - DNA, 23 bp, Artificial Sequence
  Synthetic nucleic acid molecule
agaaacgtggaaaagagtgagga

SEQ ID NO: 7577 - DNA, 23 bp, Artificial Sequence
  Synthetic nucleic acid molecule
aacagggaccttatgagtgagga

SEQ ID NO: 7578 - DNA, 23 bp, Artificial Sequence
  Synthetic nucleic acid molecule
agcaaggacttaaagagtgagga

SEQ ID NO: 7579 - DNA, 23 bp, Artificial Sequence
  Synthetic nucleic acid molecule
agcagatgcccttggagtgagga

SEQ ID NO: 7580 - DNA, 23 bp, Artificial Sequence
  Synthetic nucleic acid molecule
agcagctgtgcatagagtgagga

SEQ ID NO: 7581 - DNA, 24 bp, Artificial Sequence
  Synthetic nucleic acid molecule
agaagggtttgtgcagagtgagga

SEQ ID NO: 7582 - DNA, 23 bp, Artificial Sequence
  Synthetic nucleic acid molecule
aacagagtggtttagagtgagga

SEQ ID NO: 7583 - DNA, 23 bp, Artificial Sequence
  Synthetic nucleic acid molecule
ggcagtggcagtgggagtgagga

SEQ ID NO: 7584 - DNA, 23 bp, Artificial Sequence
  Synthetic nucleic acid molecule
agcaccgagcccctgagtgagga

SEQ ID NO: 7585 - DNA, 23 bp, Artificial Sequence
  Synthetic nucleic acid molecule
atcagcatgaaatggagtgagga

SEQ ID NO: 7586 - DNA, 23 bp, Artificial Sequence
  Synthetic nucleic acid molecule
agctgtgtgaccctgagtgagga

SEQ ID NO: 7587 - DNA, 24 bp, Artificial Sequence
  Synthetic nucleic acid molecule
tgcagggtgggaatagagtgagga

SEQ ID NO: 7588 - DNA, 23 bp, Artificial Sequence
  Synthetic nucleic acid molecule
tgcagggtgtagtggagtgagga

SEQ ID NO: 7589 - DNA, 24 bp, Artificial Sequence
  Synthetic nucleic acid molecule
aggaggttctgggaggagtgagga

SEQ ID NO: 7590 - DNA, 24 bp, Artificial Sequence
  Synthetic nucleic acid molecule
aggaatgtcctggtcgagtgagga

SEQ ID NO: 7591 - DNA, 24 bp, Artificial Sequence
  Synthetic nucleic acid molecule
agtagctgcctttgggagtgagga

SEQ ID NO: 7592 - DNA, 24 bp, Artificial Sequence
  Synthetic nucleic acid molecule
agaagggtgggaggggagtgagga

SEQ ID NO: 7593 - DNA, 24 bp, Artificial Sequence
  Synthetic nucleic acid molecule
agtagctgcctttgggagtgagga

SEQ ID NO: 7594 - DNA, 24 bp, Artificial Sequence
  Synthetic nucleic acid molecule
agtagctgcctttgggagtgagga

SEQ ID NO: 7595 - DNA, 24 bp, Artificial Sequence
  Synthetic nucleic acid molecule
agtagctgcctttgggagtgagga

SEQ ID NO: 7596 - DNA, 24 bp, Artificial Sequence
  Synthetic nucleic acid molecule
agtagctgcctttgggagtgagga

SEQ ID NO: 7597 - DNA, 24 bp, Artificial Sequence
  Synthetic nucleic acid molecule
agtagctgcctttgggagtgagga

SEQ ID NO: 7598 - DNA, 24 bp, Artificial Sequence
  Synthetic nucleic acid molecule
agtagctgcctttgggagtgagga

SEQ ID NO: 7599 - DNA, 24 bp, Artificial Sequence
  Synthetic nucleic acid molecule
agtagctgcctttgggagtgagga

SEQ ID NO: 7600 - DNA, 23 bp, Artificial Sequence
  Synthetic nucleic acid molecule
agtagaggctggaggagtgagga

SEQ ID NO: 7601 - DNA, 24 bp, Artificial Sequence
  Synthetic nucleic acid molecule
ggcagcagcaatagagagtgagga

SEQ ID NO: 7602 - DNA, 24 bp, Artificial Sequence
  Synthetic nucleic acid molecule
agcagcacaagcactgagtgagga

SEQ ID NO: 7603 - DNA, 23 bp, Artificial Sequence
  Synthetic nucleic acid molecule
tgcatcgtaagcatgagtgagga

SEQ ID NO: 7604 - DNA, 23 bp, Artificial Sequence
  Synthetic nucleic acid molecule
ggcagggtgggggtgagtgagga

SEQ ID NO: 7605 - DNA, 24 bp, Artificial Sequence
  Synthetic nucleic acid molecule
agcagctgaaagagggagtgagga

SEQ ID NO: 7606 - DNA, 24 bp, Artificial Sequence
  Synthetic nucleic acid molecule
tggagcgtgggaggagagtgagga

SEQ ID NO: 7607 - DNA, 24 bp, Artificial Sequence
  Synthetic nucleic acid molecule
tccagggtcactaatgagtgagga

SEQ ID NO: 7608 - DNA, 23 bp, Artificial Sequence
  Synthetic nucleic acid molecule
tgcagcgaaaggcagagtgagga

SEQ ID NO: 7609 - DNA, 23 bp, Artificial Sequence
  Synthetic nucleic acid molecule
agcaggttggggaagagtgagga

SEQ ID NO: 7610 - DNA, 23 bp, Artificial Sequence
  Synthetic nucleic acid molecule
agctgaggctggcagagtgagga

SEQ ID NO: 7611 - DNA, 24 bp, Artificial Sequence
  Synthetic nucleic acid molecule
aacagtggcaaatgagagtgagga

SEQ ID NO: 7612 - DNA, 24 bp, Artificial Sequence
  Synthetic nucleic acid molecule
ggcagtgcctgaagggagtgagga

SEQ ID NO: 7613 - DNA, 24 bp, Artificial Sequence
  Synthetic nucleic acid molecule
ggcagtgcctgaagggagtgagga

SEQ ID NO: 7614 - DNA, 24 bp, Artificial Sequence
  Synthetic nucleic acid molecule
ggcagtgcctgaagggagtgagga

SEQ ID NO: 7615 - DNA, 23 bp, Artificial Sequence
  Synthetic nucleic acid molecule
aggagagtatggaggagtgagga

SEQ ID NO: 7616 - DNA, 24 bp, Artificial Sequence
  Synthetic nucleic acid molecule
cgcagcattgcagcggagtgagga

SEQ ID NO: 7617 - DNA, 24 bp, Artificial Sequence
  Synthetic nucleic acid molecule
ggaagtgtccttcaagagtgagga

SEQ ID NO: 7618 - DNA, 24 bp, Artificial Sequence
  Synthetic nucleic acid molecule
agctgcataaggaaagagtgagga

SEQ ID NO: 7619 - DNA, 24 bp, Artificial Sequence
  Synthetic nucleic acid molecule
actagggtctttggagagtgagga

SEQ ID NO: 7620 - DNA, 23 bp, Artificial Sequence
  Synthetic nucleic acid molecule
agctgtgtgccagggagtgagga

SEQ ID NO: 7621 - DNA, 24 bp, Artificial Sequence
  Synthetic nucleic acid molecule
accactgtcagctgtgagtgagga

SEQ ID NO: 7622 - DNA, 23 bp, Artificial Sequence
  Synthetic nucleic acid molecule
ggtagcttctcctggagtgagga

SEQ ID NO: 7623 - DNA, 24 bp, Artificial Sequence
  Synthetic nucleic acid molecule
agcagggctgggcaggagtgagga

SEQ ID NO: 7624 - DNA, 24 bp, Artificial Sequence
  Synthetic nucleic acid molecule
agctgtgtgatgggagagtgagga

SEQ ID NO: 7625 - DNA, 23 bp, Artificial Sequence
  Synthetic nucleic acid molecule
tgaagagtccaagggagtgagga

SEQ ID NO: 7626 - DNA, 23 bp, Artificial Sequence
  Synthetic nucleic acid molecule
tgaagagtccaagggagtgagga

SEQ ID NO: 7627 - DNA, 23 bp, Artificial Sequence
  Synthetic nucleic acid molecule
acgagggtccataggagtgagga

SEQ ID NO: 7628 - DNA, 23 bp, Artificial Sequence
  Synthetic nucleic acid molecule
agaagcggtggagtgagtgagga

SEQ ID NO: 7629 - DNA, 24 bp, Artificial Sequence
  Synthetic nucleic acid molecule
ggcagagttgtactggagtgagga

SEQ ID NO: 7630 - DNA, 24 bp, Artificial Sequence
  Synthetic nucleic acid molecule
agcagttacggcaaagagtgagga

SEQ ID NO: 7631 - DNA, 24 bp, Artificial Sequence
  Synthetic nucleic acid molecule
tgcagtgtgcaaggagagtgagga

SEQ ID NO: 7632 - DNA, 23 bp, Artificial Sequence
  Synthetic nucleic acid molecule
ctctgcgtctggaagagtgagga

SEQ ID NO: 7633 - DNA, 24 bp, Artificial Sequence
  Synthetic nucleic acid molecule
aggagagtgagagaagagtgagga

SEQ ID NO: 7634 - DNA, 24 bp, Artificial Sequence
  Synthetic nucleic acid molecule
aggagagtgagagaagagtgagga

SEQ ID NO: 7635 - DNA, 24 bp, Artificial Sequence
  Synthetic nucleic acid molecule
aatagggtcaggtaggagtgagga

SEQ ID NO: 7636 - DNA, 24 bp, Artificial Sequence
  Synthetic nucleic acid molecule
agcagcgtctccgaagactcatgt

SEQ ID NO: 7637 - DNA, 24 bp, Artificial Sequence
  Synthetic nucleic acid molecule
agcagcgtcacataatagtggagc

SEQ ID NO: 7638 - DNA, 23 bp, Artificial Sequence
  Synthetic nucleic acid molecule
agcagcgtccaggagtgggagtc

SEQ ID NO: 7639 - DNA, 24 bp, Artificial Sequence
  Synthetic nucleic acid molecule
agcagcgtctggtctggcggaggc

SEQ ID NO: 7640 - DNA, 23 bp, Artificial Sequence
  Synthetic nucleic acid molecule
agcagcgtcttagaaggtgacaa

SEQ ID NO: 7641 - DNA, 24 bp, Artificial Sequence
  Synthetic nucleic acid molecule
agcagcgtcagaggagggagacca

SEQ ID NO: 7642 - DNA, 24 bp, Artificial Sequence
  Synthetic nucleic acid molecule
agcagcgtcactggtaagacatga

SEQ ID NO: 7643 - DNA, 23 bp, Artificial Sequence
  Synthetic nucleic acid molecule
agcagcgtccctggcatggagca

SEQ ID NO: 7644 - DNA, 24 bp, Artificial Sequence
  Synthetic nucleic acid molecule
agcagcgtctgacagcagtgaaac

SEQ ID NO: 7645 - DNA, 24 bp, Artificial Sequence
  Synthetic nucleic acid molecule
agcagcgtctccagggtgtgctgc

SEQ ID NO: 7646 - DNA, 23 bp, Artificial Sequence
  Synthetic nucleic acid molecule
agcagcgtctcagaggtagagca

SEQ ID NO: 7647 - DNA, 24 bp, Artificial Sequence
  Synthetic nucleic acid molecule
agcagcgtcgagacccatggagca

SEQ ID NO: 7648 - DNA, 23 bp, Artificial Sequence
  Synthetic nucleic acid molecule
agcagcgtcgtggcagggcagga

SEQ ID NO: 7649 - DNA, 23 bp, Artificial Sequence
  Synthetic nucleic acid molecule
agcagcgtcctggggagcgcgtc

SEQ ID NO: 7650 - DNA, 24 bp, Artificial Sequence
  Synthetic nucleic acid molecule
agcagcgtcgttcggggctgagat

SEQ ID NO: 7651 - DNA, 23 bp, Artificial Sequence
  Synthetic nucleic acid molecule
agcagcgtcaggctgtgggagcc

SEQ ID NO: 7652 - DNA, 23 bp, Artificial Sequence
  Synthetic nucleic acid molecule
agcagcgtccactgtggtaagca

SEQ ID NO: 7653 - DNA, 24 bp, Artificial Sequence
  Synthetic nucleic acid molecule
agcagcgtctgcatggtgtgttgc

SEQ ID NO: 7654 - DNA, 24 bp, Artificial Sequence
  Synthetic nucleic acid molecule
agcagcgtctaatacaattgagtt

SEQ ID NO: 7655 - DNA, 24 bp, Artificial Sequence
  Synthetic nucleic acid molecule
agcagcgtcaactgtgtgagttga

SEQ ID NO: 7656 - DNA, 24 bp, Artificial Sequence
  Synthetic nucleic acid molecule
agcagcgtcaagtctgtgtgctgc

SEQ ID NO: 7657 - DNA, 24 bp, Artificial Sequence
  Synthetic nucleic acid molecule
agcagcgtctacagtgactgccgt

SEQ ID NO: 7658 - DNA, 23 bp, Artificial Sequence
  Synthetic nucleic acid molecule
agcagcgtctgtgccatggagca

SEQ ID NO: 7659 - DNA, 23 bp, Artificial Sequence
  Synthetic nucleic acid molecule
agcagcgtctccttgagcggtgc

SEQ ID NO: 7660 - DNA, 24 bp, Artificial Sequence
  Synthetic nucleic acid molecule
agcagcgtctccttgggcagaggt

SEQ ID NO: 7661 - DNA, 23 bp, Artificial Sequence
  Synthetic nucleic acid molecule
agcagcgtcacgtgccgctagga

SEQ ID NO: 7662 - DNA, 23 bp, Artificial Sequence
  Synthetic nucleic acid molecule
agccgcgtcgcggagagggcggc

SEQ ID NO: 7663 - DNA, 24 bp, Artificial Sequence
  Synthetic nucleic acid molecule
agcagtgtcctgagggtgtgaagg

SEQ ID NO: 7664 - DNA, 23 bp, Artificial Sequence
  Synthetic nucleic acid molecule
agcagtgtcagattaagtgagcc

SEQ ID NO: 7665 - DNA, 23 bp, Artificial Sequence
  Synthetic nucleic acid molecule
agcatcgtcaattacagtgaaaa

SEQ ID NO: 7666 - DNA, 23 bp, Artificial Sequence
  Synthetic nucleic acid molecule
agcagcggctgtggcagtgtggt

SEQ ID NO: 7667 - DNA, 24 bp, Artificial Sequence
  Synthetic nucleic acid molecule
agcaacgtcgtgacagagcctgga

SEQ ID NO: 7668 - DNA, 23 bp, Artificial Sequence
  Synthetic nucleic acid molecule
agcagtgtcacagtgtgtgagag

SEQ ID NO: 7669 - DNA, 24 bp, Artificial Sequence
  Synthetic nucleic acid molecule
agcagcggctcccaggagaggggc

SEQ ID NO: 7670 - DNA, 24 bp, Artificial Sequence
  Synthetic nucleic acid molecule
agcaacgtcagcaaagtctcagga

SEQ ID NO: 7671 - DNA, 24 bp, Artificial Sequence
  Synthetic nucleic acid molecule
agcaacgtcagcaaagtctcagga

SEQ ID NO: 7672 - DNA, 23 bp, Artificial Sequence
  Synthetic nucleic acid molecule
agtagcgtctcgctgtgtgagtg

SEQ ID NO: 7673 - DNA, 24 bp, Artificial Sequence
  Synthetic nucleic acid molecule
agcaacgtcagcagagtctcagga

SEQ ID NO: 7674 - DNA, 23 bp, Artificial Sequence
  Synthetic nucleic acid molecule
agcagcgttattctgagtgatat

SEQ ID NO: 7675 - DNA, 23 bp, Artificial Sequence
  Synthetic nucleic acid molecule
agcagtgtccagtagtgtaaggt

SEQ ID NO: 7676 - DNA, 24 bp, Artificial Sequence
  Synthetic nucleic acid molecule
agcaacgtcagcaaagtctcagga

SEQ ID NO: 7677 - DNA, 24 bp, Artificial Sequence
  Synthetic nucleic acid molecule
agcaacgtcagcaaagtctcagga

SEQ ID NO: 7678 - DNA, 24 bp, Artificial Sequence
  Synthetic nucleic acid molecule
ggcagcgtcgggatatggtgaggg

SEQ ID NO: 7679 - DNA, 24 bp, Artificial Sequence
  Synthetic nucleic acid molecule
agcaacgtcagcaaagtctcagga

SEQ ID NO: 7680 - DNA, 23 bp, Artificial Sequence
  Synthetic nucleic acid molecule
agcagagtcgctcactgtgaggc

SEQ ID NO: 7681 - DNA, 24 bp, Artificial Sequence
  Synthetic nucleic acid molecule
agcagcggcagcggcgagggcggc

SEQ ID NO: 7682 - DNA, 24 bp, Artificial Sequence
  Synthetic nucleic acid molecule
agcagtgtcagagcagagagagcc

SEQ ID NO: 7683 - DNA, 24 bp, Artificial Sequence
  Synthetic nucleic acid molecule
agcatcgtctgatccttgtgaggg

SEQ ID NO: 7684 - DNA, 24 bp, Artificial Sequence
  Synthetic nucleic acid molecule
agcaacgtcagcaaagtctcagga

SEQ ID NO: 7685 - DNA, 24 bp, Artificial Sequence
  Synthetic nucleic acid molecule
agcaacgtcagcaaagtctcagga

SEQ ID NO: 7686 - DNA, 23 bp, Artificial Sequence
  Synthetic nucleic acid molecule
agcagggtctcctgtagtgagtc

SEQ ID NO: 7687 - DNA, 24 bp, Artificial Sequence
  Synthetic nucleic acid molecule
accagcgtctgcttctggtgaggc

SEQ ID NO: 7688 - DNA, 24 bp, Artificial Sequence
  Synthetic nucleic acid molecule
agcaacgtcagcaaagtctcagga

SEQ ID NO: 7689 - DNA, 23 bp, Artificial Sequence
  Synthetic nucleic acid molecule
agcagcatcagctggaggaaggg

SEQ ID NO: 7690 - DNA, 24 bp, Artificial Sequence
  Synthetic nucleic acid molecule
agcagcggcaacgatgagcaagaa

SEQ ID NO: 7691 - DNA, 24 bp, Artificial Sequence
  Synthetic nucleic acid molecule
agcagtgtcagcagcaagtgtggt

SEQ ID NO: 7692 - DNA, 24 bp, Artificial Sequence
  Synthetic nucleic acid molecule
agcaacgtcagcaaagtctcagga

SEQ ID NO: 7693 - DNA, 24 bp, Artificial Sequence
  Synthetic nucleic acid molecule
agcagcggccacagaggttgaggc

SEQ ID NO: 7694 - DNA, 23 bp, Artificial Sequence
  Synthetic nucleic acid molecule
agcagcggcacctggggagaggc

SEQ ID NO: 7695 - DNA, 24 bp, Artificial Sequence
  Synthetic nucleic acid molecule
agcagtgtcagtggtggaggagga

SEQ ID NO: 7696 - DNA, 24 bp, Artificial Sequence
  Synthetic nucleic acid molecule
agcaacgtcagcaaagtctcagga

SEQ ID NO: 7697 - DNA, 24 bp, Artificial Sequence
  Synthetic nucleic acid molecule
agcagagtcctgggagactgaaca

SEQ ID NO: 7698 - DNA, 23 bp, Artificial Sequence
  Synthetic nucleic acid molecule
agcagtgtcagatagagggagcc

SEQ ID NO: 7699 - DNA, 24 bp, Artificial Sequence
  Synthetic nucleic acid molecule
agcagtgtccatttgaagggaggt

SEQ ID NO: 7700 - DNA, 23 bp, Artificial Sequence
  Synthetic nucleic acid molecule
tgcagcgtctgtgtgagtgtcgt

SEQ ID NO: 7701 - DNA, 23 bp, Artificial Sequence
  Synthetic nucleic acid molecule
ggcagcgtctgtctgtgtgagct

SEQ ID NO: 7702 - DNA, 24 bp, Artificial Sequence
  Synthetic nucleic acid molecule
agcagcgtgttttaagagtgaaag

SEQ ID NO: 7703 - DNA, 24 bp, Artificial Sequence
  Synthetic nucleic acid molecule
agcagcggctgtgaaaggtgaggt

SEQ ID NO: 7704 - DNA, 23 bp, Artificial Sequence
  Synthetic nucleic acid molecule
agcagtgtccaggaggaggagga

SEQ ID NO: 7705 - DNA, 24 bp, Artificial Sequence
  Synthetic nucleic acid molecule
agcagtgtcttgcatgtgggaggt

SEQ ID NO: 7706 - DNA, 24 bp, Artificial Sequence
  Synthetic nucleic acid molecule
accagcgtctgcttctggtgaggc

SEQ ID NO: 7707 - DNA, 24 bp, Artificial Sequence
  Synthetic nucleic acid molecule
agcaacgtccatcctgagagatgg

SEQ ID NO: 7708 - DNA, 24 bp, Artificial Sequence
  Synthetic nucleic acid molecule
agcaacgtcagcaaagtctcagga

SEQ ID NO: 7709 - DNA, 24 bp, Artificial Sequence
  Synthetic nucleic acid molecule
agcaacgtcacaggtgagttgaga

SEQ ID NO: 7710 - DNA, 23 bp, Artificial Sequence
  Synthetic nucleic acid molecule
agcaacgtccagaaaattgagca

SEQ ID NO: 7711 - DNA, 23 bp, Artificial Sequence
  Synthetic nucleic acid molecule
agcagtgtctttttgagtaggca

SEQ ID NO: 7712 - DNA, 23 bp, Artificial Sequence
  Synthetic nucleic acid molecule
agcagcggcagcattagggaggt

SEQ ID NO: 7713 - DNA, 24 bp, Artificial Sequence
  Synthetic nucleic acid molecule
agcagtgtcctcatgggaggagga

SEQ ID NO: 7714 - DNA, 23 bp, Artificial Sequence
  Synthetic nucleic acid molecule
agcagcggccaagagagtgaatt

SEQ ID NO: 7715 - DNA, 24 bp, Artificial Sequence
  Synthetic nucleic acid molecule
agcaacgtcagcaaagtctcagga

SEQ ID NO: 7716 - DNA, 23 bp, Artificial Sequence
  Synthetic nucleic acid molecule
agcagagtcagggagactgagtc

SEQ ID NO: 7717 - DNA, 24 bp, Artificial Sequence
  Synthetic nucleic acid molecule
agcagtgtccagcgtgagggagat

SEQ ID NO: 7718 - DNA, 23 bp, Artificial Sequence
  Synthetic nucleic acid molecule
agcaccgtctgggagtatgaggc

SEQ ID NO: 7719 - DNA, 24 bp, Artificial Sequence
  Synthetic nucleic acid molecule
accagcgtccacttctggtgaggc

SEQ ID NO: 7720 - DNA, 24 bp, Artificial Sequence
  Synthetic nucleic acid molecule
agcaacgtcagcaaagtctcagga

SEQ ID NO: 7721 - DNA, 24 bp, Artificial Sequence
  Synthetic nucleic acid molecule
agcaacgtcagcaaagtctcagga

SEQ ID NO: 7722 - DNA, 24 bp, Artificial Sequence
  Synthetic nucleic acid molecule
agcaacgtcagaaaagtctcagga

SEQ ID NO: 7723 - DNA, 23 bp, Artificial Sequence
  Synthetic nucleic acid molecule
agcagggtccaaaagagtgattt

SEQ ID NO: 7724 - DNA, 24 bp, Artificial Sequence
  Synthetic nucleic acid molecule
agcagtgtcagcccagagtgaatt

SEQ ID NO: 7725 - DNA, 24 bp, Artificial Sequence
  Synthetic nucleic acid molecule
agcaacgtcagcaaagtctcagga

SEQ ID NO: 7726 - DNA, 24 bp, Artificial Sequence
  Synthetic nucleic acid molecule
agcaacgtcagcaaagtctcagga

SEQ ID NO: 7727 - DNA, 24 bp, Artificial Sequence
  Synthetic nucleic acid molecule
agcagtgtcaactaggagtaggca

SEQ ID NO: 7728 - DNA, 23 bp, Artificial Sequence
  Synthetic nucleic acid molecule
agcagcggcattacgagtaagct

SEQ ID NO: 7729 - DNA, 24 bp, Artificial Sequence
  Synthetic nucleic acid molecule
agcaacgtcagcaaagtctcagga

SEQ ID NO: 7730 - DNA, 24 bp, Artificial Sequence
  Synthetic nucleic acid molecule
agcaacgtcaacaaagtctcagga

SEQ ID NO: 7731 - DNA, 23 bp, Artificial Sequence
  Synthetic nucleic acid molecule
agcagcttcctctggggagtgga

SEQ ID NO: 7732 - DNA, 23 bp, Artificial Sequence
  Synthetic nucleic acid molecule
agcagtgtctccccgagggaaaa

SEQ ID NO: 7733 - DNA, 23 bp, Artificial Sequence
  Synthetic nucleic acid molecule
agcatcgtccggggaggtgagaa

SEQ ID NO: 7734 - DNA, 23 bp, Artificial Sequence
  Synthetic nucleic acid molecule
agcagcggctctcaaagtgtggt

SEQ ID NO: 7735 - DNA, 23 bp, Artificial Sequence
  Synthetic nucleic acid molecule
agcatcgtccggggaggtgagaa

SEQ ID NO: 7736 - DNA, 24 bp, Artificial Sequence
  Synthetic nucleic acid molecule
agcagcgttcacactcagagaggt

SEQ ID NO: 7737 - DNA, 24 bp, Artificial Sequence
  Synthetic nucleic acid molecule
agcagcggccggagcaagagaggg

SEQ ID NO: 7738 - DNA, 23 bp, Artificial Sequence
  Synthetic nucleic acid molecule
aacagcgtcaatgtgtgtgagag

SEQ ID NO: 7739 - DNA, 23 bp, Artificial Sequence
  Synthetic nucleic acid molecule
agcatcgtccggggaggtgagaa

SEQ ID NO: 7740 - DNA, 23 bp, Artificial Sequence
  Synthetic nucleic acid molecule
agcatcgtccggggaggtgagaa

SEQ ID NO: 7741 - DNA, 23 bp, Artificial Sequence
  Synthetic nucleic acid molecule
agcatcgtctggggaggtgagaa

SEQ ID NO: 7742 - DNA, 23 bp, Artificial Sequence
  Synthetic nucleic acid molecule
agcatcgtccggggaggtgagaa

SEQ ID NO: 7743 - DNA, 23 bp, Artificial Sequence
  Synthetic nucleic acid molecule
agcagcatcagcgagaggaaggg

SEQ ID NO: 7744 - DNA, 24 bp, Artificial Sequence
  Synthetic nucleic acid molecule
agcaacgtcagcaaagtctcagga

SEQ ID NO: 7745 - DNA, 24 bp, Artificial Sequence
  Synthetic nucleic acid molecule
agcaccgtccagtgtgggtgaagc

SEQ ID NO: 7746 - DNA, 24 bp, Artificial Sequence
  Synthetic nucleic acid molecule
agcaacgtcagcaaagtctcagga

SEQ ID NO: 7747 - DNA, 23 bp, Artificial Sequence
  Synthetic nucleic acid molecule
aacagcgtcaacgtgagtgaatt

SEQ ID NO: 7748 - DNA, 24 bp, Artificial Sequence
  Synthetic nucleic acid molecule
agcaacgtcagcaaagtctcagga

SEQ ID NO: 7749 - DNA, 24 bp, Artificial Sequence
  Synthetic nucleic acid molecule
agcaacgtcagcaaagtctcagga

SEQ ID NO: 7750 - DNA, 24 bp, Artificial Sequence
  Synthetic nucleic acid molecule
agcaccgtctcctgagggtgagtg

SEQ ID NO: 7751 - DNA, 24 bp, Artificial Sequence
  Synthetic nucleic acid molecule
agcaccgtcctttccgtgtggggt

SEQ ID NO: 7752 - DNA, 24 bp, Artificial Sequence
  Synthetic nucleic acid molecule
agcagggtcaaaaagtagtgttga

SEQ ID NO: 7753 - DNA, 24 bp, Artificial Sequence
  Synthetic nucleic acid molecule
agcaacgtccctcatgaataaaga

SEQ ID NO: 7754 - DNA, 24 bp, Artificial Sequence
  Synthetic nucleic acid molecule
agcaacgtcagcaaagtctcagga

SEQ ID NO: 7755 - DNA, 23 bp, Artificial Sequence
  Synthetic nucleic acid molecule
agcagcttctctgagggagtgga

SEQ ID NO: 7756 - DNA, 24 bp, Artificial Sequence
  Synthetic nucleic acid molecule
ggcagcgtctgggatgaggaaggc

SEQ ID NO: 7757 - DNA, 24 bp, Artificial Sequence
  Synthetic nucleic acid molecule
agcaacgtcagcaaagtctcagga

SEQ ID NO: 7758 - DNA, 23 bp, Artificial Sequence
  Synthetic nucleic acid molecule
agcagcggcaacttaagagtgga

SEQ ID NO: 7759 - DNA, 23 bp, Artificial Sequence
  Synthetic nucleic acid molecule
agcagcggcctcagaagtgagcc

SEQ ID NO: 7760 - DNA, 24 bp, Artificial Sequence
  Synthetic nucleic acid molecule
agcagtgtctgcacagagtaggca

SEQ ID NO: 7761 - DNA, 24 bp, Artificial Sequence
  Synthetic nucleic acid molecule
agcagtgtcccgaggctgtgaggc

SEQ ID NO: 7762 - DNA, 24 bp, Artificial Sequence
  Synthetic nucleic acid molecule
agcaacgtcagcaaagtctcagga

SEQ ID NO: 7763 - DNA, 24 bp, Artificial Sequence
  Synthetic nucleic acid molecule
agcaacgtcagcaaagtctcagga

SEQ ID NO: 7764 - DNA, 23 bp, Artificial Sequence
  Synthetic nucleic acid molecule
agcagtgtccagcacagtgagat

SEQ ID NO: 7765 - DNA, 24 bp, Artificial Sequence
  Synthetic nucleic acid molecule
agcaacgtccagagggaggaaaga

SEQ ID NO: 7766 - DNA, 24 bp, Artificial Sequence
  Synthetic nucleic acid molecule
agcagcgtgttaattaagtgagtc

SEQ ID NO: 7767 - DNA, 23 bp, Artificial Sequence
  Synthetic nucleic acid molecule
agcagggtctaagggagtgattt

SEQ ID NO: 7768 - DNA, 23 bp, Artificial Sequence
  Synthetic nucleic acid molecule
agcaccgtctgggagtttcagga

SEQ ID NO: 7769 - DNA, 23 bp, Artificial Sequence
  Synthetic nucleic acid molecule
agcaccgtctgggagtttcagga

SEQ ID NO: 7770 - DNA, 24 bp, Artificial Sequence
  Synthetic nucleic acid molecule
atcagcgtccagcgtgaggtaggc

SEQ ID NO: 7771 - DNA, 23 bp, Artificial Sequence
  Synthetic nucleic acid molecule
agcatcgtcaattatagtgagac

SEQ ID NO: 7772 - DNA, 24 bp, Artificial Sequence
  Synthetic nucleic acid molecule
agcaacgtcagcaaagtctcagga

SEQ ID NO: 7773 - DNA, 23 bp, Artificial Sequence
  Synthetic nucleic acid molecule
agcagcgacatcctgagtgggct

SEQ ID NO: 7774 - DNA, 24 bp, Artificial Sequence
  Synthetic nucleic acid molecule
agcaccgtccagacagagcaggga

SEQ ID NO: 7775 - DNA, 24 bp, Artificial Sequence
  Synthetic nucleic acid molecule
agcagtgtcattttctggtgaggg

SEQ ID NO: 7776 - DNA, 23 bp, Artificial Sequence
  Synthetic nucleic acid molecule
agcagtgtcctgtggagtgttgg

SEQ ID NO: 7777 - DNA, 23 bp, Artificial Sequence
  Synthetic nucleic acid molecule
agcagcggcgaggttagtgtggt

SEQ ID NO: 7778 - DNA, 24 bp, Artificial Sequence
  Synthetic nucleic acid molecule
agcagggtccacagtgtgtgagat

SEQ ID NO: 7779 - DNA, 23 bp, Artificial Sequence
  Synthetic nucleic acid molecule
agcaccggccggccgagggaggg

SEQ ID NO: 7780 - DNA, 23 bp, Artificial Sequence
  Synthetic nucleic acid molecule
agcagagtgccagggagtgagat

SEQ ID NO: 7781 - DNA, 24 bp, Artificial Sequence
  Synthetic nucleic acid molecule
agcaaggtctgcattgagagaggc

SEQ ID NO: 7782 - DNA, 23 bp, Artificial Sequence
  Synthetic nucleic acid molecule
agcatggtccagcagagtgagcc

SEQ ID NO: 7783 - DNA, 24 bp, Artificial Sequence
  Synthetic nucleic acid molecule
atcagtgtcatcctggagtaaggt

SEQ ID NO: 7784 - DNA, 23 bp, Artificial Sequence
  Synthetic nucleic acid molecule
agcatggtcgtggaaagtgagta

SEQ ID NO: 7785 - DNA, 23 bp, Artificial Sequence
  Synthetic nucleic acid molecule
agcaatgtctgtgggagggaggc

SEQ ID NO: 7786 - DNA, 24 bp, Artificial Sequence
  Synthetic nucleic acid molecule
agcattgtctgcagtgagtgtggg

SEQ ID NO: 7787 - DNA, 24 bp, Artificial Sequence
  Synthetic nucleic acid molecule
agcattgtctccctccagtgaggg

SEQ ID NO: 7788 - DNA, 24 bp, Artificial Sequence
  Synthetic nucleic acid molecule
agcaaggtcagtgtctagtgaggg

SEQ ID NO: 7789 - DNA, 23 bp, Artificial Sequence
  Synthetic nucleic acid molecule
agcagggtagtggtgagtaaggt

SEQ ID NO: 7790 - DNA, 23 bp, Artificial Sequence
  Synthetic nucleic acid molecule
agcagcgcaggccggggtgaggg

SEQ ID NO: 7791 - DNA, 23 bp, Artificial Sequence
  Synthetic nucleic acid molecule
agcagcattgacatgagtgagat

SEQ ID NO: 7792 - DNA, 24 bp, Artificial Sequence
  Synthetic nucleic acid molecule
agcatggtcaggttccagtgaggg

SEQ ID NO: 7793 - DNA, 23 bp, Artificial Sequence
  Synthetic nucleic acid molecule
agctgcatcaccttgagtgagtc

SEQ ID NO: 7794 - DNA, 24 bp, Artificial Sequence
  Synthetic nucleic acid molecule
agaaacgtccaggtagagtgaaaa

SEQ ID NO: 7795 - DNA, 23 bp, Artificial Sequence
  Synthetic nucleic acid molecule
tgcagtgtcccatggagggaggt

SEQ ID NO: 7796 - DNA, 24 bp, Artificial Sequence
  Synthetic nucleic acid molecule
aacaacgtccagcaggagtgtgaa

SEQ ID NO: 7797 - DNA, 23 bp, Artificial Sequence
  Synthetic nucleic acid molecule
agcaaggtcttaaagagcgagta

SEQ ID NO: 7798 - DNA, 23 bp, Artificial Sequence
  Synthetic nucleic acid molecule
agcagtgtggggcagtgtgaggc

SEQ ID NO: 7799 - DNA, 23 bp, Artificial Sequence
  Synthetic nucleic acid molecule
agtagtgtcctgtggagggaggc

SEQ ID NO: 7800 - DNA, 24 bp, Artificial Sequence
  Synthetic nucleic acid molecule
agcagggttggtttctagtgaggc

SEQ ID NO: 7801 - DNA, 24 bp, Artificial Sequence
  Synthetic nucleic acid molecule
agcatggtcaggttccagtgaggg

SEQ ID NO: 7802 - DNA, 23 bp, Artificial Sequence
  Synthetic nucleic acid molecule
agcagcattgacatgagtgagat

SEQ ID NO: 7803 - DNA, 24 bp, Artificial Sequence
  Synthetic nucleic acid molecule
agcaccgtattctgctagtgaggg

SEQ ID NO: 7804 - DNA, 24 bp, Artificial Sequence
  Synthetic nucleic acid molecule
agctgtgtctggtgtgagtgagag

SEQ ID NO: 7805 - DNA, 23 bp, Artificial Sequence
  Synthetic nucleic acid molecule
agccgggtccccacgagtgagtg

SEQ ID NO: 7806 - DNA, 24 bp, Artificial Sequence
  Synthetic nucleic acid molecule
aacagggtcagagaagagtgagac

SEQ ID NO: 7807 - DNA, 23 bp, Artificial Sequence
  Synthetic nucleic acid molecule
agcactgtcttggaaagtgaggg

SEQ ID NO: 7808 - DNA, 24 bp, Artificial Sequence
  Synthetic nucleic acid molecule
agcaacgtggcagaggagggaggt

SEQ ID NO: 7809 - DNA, 24 bp, Artificial Sequence
  Synthetic nucleic acid molecule
agcagggtgggaactgagggaggt

SEQ ID NO: 7810 - DNA, 23 bp, Artificial Sequence
  Synthetic nucleic acid molecule
agcacagtcttggggagagaggc

SEQ ID NO: 7811 - DNA, 23 bp, Artificial Sequence
  Synthetic nucleic acid molecule
agcattgtcacacagagtgaata

SEQ ID NO: 7812 - DNA, 24 bp, Artificial Sequence
  Synthetic nucleic acid molecule
atcagagtcagcttagagtgagag

SEQ ID NO: 7813 - DNA, 23 bp, Artificial Sequence
  Synthetic nucleic acid molecule
agcaacctccaggtgagggaggc

SEQ ID NO: 7814 - DNA, 24 bp, Artificial Sequence
  Synthetic nucleic acid molecule
agcggagtcgctggggagagaggg

SEQ ID NO: 7815 - DNA, 24 bp, Artificial Sequence
  Synthetic nucleic acid molecule
agcatggtccatttctagtgaggc

SEQ ID NO: 7816 - DNA, 24 bp, Artificial Sequence
  Synthetic nucleic acid molecule
tgcagtgtccacagcaagtgaggt

SEQ ID NO: 7817 - DNA, 24 bp, Artificial Sequence
  Synthetic nucleic acid molecule
ggcaccgtcctcctggagggaggc

SEQ ID NO: 7818 - DNA, 24 bp, Artificial Sequence
  Synthetic nucleic acid molecule
agcaaagtctctaaagagtgtggt

SEQ ID NO: 7819 - DNA, 23 bp, Artificial Sequence
  Synthetic nucleic acid molecule
agcagcattgacatgagtgagat

SEQ ID NO: 7820 - DNA, 24 bp, Artificial Sequence
  Synthetic nucleic acid molecule
agcagcattgcacgggggtgaggt

SEQ ID NO: 7821 - DNA, 23 bp, Artificial Sequence
  Synthetic nucleic acid molecule
agcagtgacagcgggagtgagcc

SEQ ID NO: 7822 - DNA, 24 bp, Artificial Sequence
  Synthetic nucleic acid molecule
agcagtgaccaatctgagtgagcc

SEQ ID NO: 7823 - DNA, 24 bp, Artificial Sequence
  Synthetic nucleic acid molecule
agcaatgtcaacagagggtgaggg

SEQ ID NO: 7824 - DNA, 24 bp, Artificial Sequence
  Synthetic nucleic acid molecule
agcaacatctactaagagtgagcc

SEQ ID NO: 7825 - DNA, 23 bp, Artificial Sequence
  Synthetic nucleic acid molecule
tgcagggtcagggtgtgtgaggc

SEQ ID NO: 7826 - DNA, 23 bp, Artificial Sequence
  Synthetic nucleic acid molecule
agcaacggcgactggagtgacca

SEQ ID NO: 7827 - DNA, 24 bp, Artificial Sequence
  Synthetic nucleic acid molecule
agcatggtccagttccagtgaggg

SEQ ID NO: 7828 - DNA, 24 bp, Artificial Sequence
  Synthetic nucleic acid molecule
ggcagtgtcctcccacagtgaggc

SEQ ID NO: 7829 - DNA, 24 bp, Artificial Sequence
  Synthetic nucleic acid molecule
agcaccggccctgggcagtgaggg

SEQ ID NO: 7830 - DNA, 24 bp, Artificial Sequence
  Synthetic nucleic acid molecule
aacagtgtctataaatagtgaggg

SEQ ID NO: 7831 - DNA, 23 bp, Artificial Sequence
  Synthetic nucleic acid molecule
agcaaagtcagagggagtgatgt

SEQ ID NO: 7832 - DNA, 23 bp, Artificial Sequence
  Synthetic nucleic acid molecule
agcaatgtctgcatgagggaggt

SEQ ID NO: 7833 - DNA, 23 bp, Artificial Sequence
  Synthetic nucleic acid molecule
agcagtctccaggcgagagaggg

SEQ ID NO: 7834 - DNA, 24 bp, Artificial Sequence
  Synthetic nucleic acid molecule
agcaaagtccttggtaagtgaggg

SEQ ID NO: 7835 - DNA, 23 bp, Artificial Sequence
  Synthetic nucleic acid molecule
agcagcagcttagagagtgagcc

SEQ ID NO: 7836 - DNA, 23 bp, Artificial Sequence
  Synthetic nucleic acid molecule
aacatcgtcagtgggagtgtgaa

SEQ ID NO: 7837 - DNA, 24 bp, Artificial Sequence
  Synthetic nucleic acid molecule
agcaacatccttggggagtgaagt

SEQ ID NO: 7838 - DNA, 23 bp, Artificial Sequence
  Synthetic nucleic acid molecule
agccccgtcaagcagagggaggc

SEQ ID NO: 7839 - DNA, 23 bp, Artificial Sequence
  Synthetic nucleic acid molecule
agcagcggttctcagagtgtggc

SEQ ID NO: 7840 - DNA, 24 bp, Artificial Sequence
  Synthetic nucleic acid molecule
agcaaggtctgagaagagtggtga

SEQ ID NO: 7841 - DNA, 24 bp, Artificial Sequence
  Synthetic nucleic acid molecule
aacagagtcagagaggtgtgaggc

SEQ ID NO: 7842 - DNA, 24 bp, Artificial Sequence
  Synthetic nucleic acid molecule
ggcagcgtgtgacagaagtgaggg

SEQ ID NO: 7843 - DNA, 23 bp, Artificial Sequence
  Synthetic nucleic acid molecule
agcatagtctcccagagtgagtg

SEQ ID NO: 7844 - DNA, 23 bp, Artificial Sequence
  Synthetic nucleic acid molecule
agccgtgtccccttaagtgaggg

SEQ ID NO: 7845 - DNA, 23 bp, Artificial Sequence
  Synthetic nucleic acid molecule
agcatggtcaggttcagtgaggg

SEQ ID NO: 7846 - DNA, 23 bp, Artificial Sequence
  Synthetic nucleic acid molecule
agtagtgtctggtggagtgagtt

SEQ ID NO: 7847 - DNA, 23 bp, Artificial Sequence
  Synthetic nucleic acid molecule
agcagcattgacatgagtgagat

SEQ ID NO: 7848 - DNA, 24 bp, Artificial Sequence
  Synthetic nucleic acid molecule
agcagcatttcaagagagtgagag

SEQ ID NO: 7849 - DNA, 24 bp, Artificial Sequence
  Synthetic nucleic acid molecule
cgcagtgtctggtcacagtgaggc

SEQ ID NO: 7850 - DNA, 23 bp, Artificial Sequence
  Synthetic nucleic acid molecule
agcagggtggggaagagggaggt

SEQ ID NO: 7851 - DNA, 24 bp, Artificial Sequence
  Synthetic nucleic acid molecule
agcagggtaatgtgagagtgagtg

SEQ ID NO: 7852 - DNA, 23 bp, Artificial Sequence
  Synthetic nucleic acid molecule
agcatagtcacttagagtgtggg

SEQ ID NO: 7853 - DNA, 24 bp, Artificial Sequence
  Synthetic nucleic acid molecule
agcatggtcaggttccagtgaggg

SEQ ID NO: 7854 - DNA, 24 bp, Artificial Sequence
  Synthetic nucleic acid molecule
tccagcgtcgtgacagagtgagac

SEQ ID NO: 7855 - DNA, 24 bp, Artificial Sequence
  Synthetic nucleic acid molecule
agcactgtcctgtcagagtgtggc

SEQ ID NO: 7856 - DNA, 23 bp, Artificial Sequence
  Synthetic nucleic acid molecule
agcatagtccagttcagtgaggc

SEQ ID NO: 7857 - DNA, 24 bp, Artificial Sequence
  Synthetic nucleic acid molecule
agcagtgtgcaccacgagagaggc

SEQ ID NO: 7858 - DNA, 24 bp, Artificial Sequence
  Synthetic nucleic acid molecule
agcaacggcaggagagagagggga

SEQ ID NO: 7859 - DNA, 23 bp, Artificial Sequence
  Synthetic nucleic acid molecule
agccgggtcaccgagagtgagtg

SEQ ID NO: 7860 - DNA, 24 bp, Artificial Sequence
  Synthetic nucleic acid molecule
agcaatgtcaattttcagtgagca

SEQ ID NO: 7861 - DNA, 23 bp, Artificial Sequence
  Synthetic nucleic acid molecule
agcaacgtgtggagcagtgaggg

SEQ ID NO: 7862 - DNA, 24 bp, Artificial Sequence
  Synthetic nucleic acid molecule
agcacggtcagtcttcagtgaggg

SEQ ID NO: 7863 - DNA, 24 bp, Artificial Sequence
  Synthetic nucleic acid molecule
agcatggtcatgttatagtgagta

SEQ ID NO: 7864 - DNA, 23 bp, Artificial Sequence
  Synthetic nucleic acid molecule
agcagggtagggaggagtgagtg

SEQ ID NO: 7865 - DNA, 24 bp, Artificial Sequence
  Synthetic nucleic acid molecule
agcggtgtctgaaaaaagtgaggg

SEQ ID NO: 7866 - DNA, 24 bp, Artificial Sequence
  Synthetic nucleic acid molecule
agcaaggtccatccagagagaggc

SEQ ID NO: 7867 - DNA, 24 bp, Artificial Sequence
  Synthetic nucleic acid molecule
agcaccttctagggagtgtgaggc

SEQ ID NO: 7868 - DNA, 24 bp, Artificial Sequence
  Synthetic nucleic acid molecule
agcaaagtctcacaggagggaggc

SEQ ID NO: 7869 - DNA, 23 bp, Artificial Sequence
  Synthetic nucleic acid molecule
agcaaggtctgggagagtgatgt

SEQ ID NO: 7870 - DNA, 24 bp, Artificial Sequence
  Synthetic nucleic acid molecule
agcagcagctgccgggagcgaggc

SEQ ID NO: 7871 - DNA, 23 bp, Artificial Sequence
  Synthetic nucleic acid molecule
agcaacctcctggggagtgtggg

SEQ ID NO: 7872 - DNA, 24 bp, Artificial Sequence
  Synthetic nucleic acid molecule
tgcagcgactgaagtgagtgagtg

SEQ ID NO: 7873 - DNA, 23 bp, Artificial Sequence
  Synthetic nucleic acid molecule
ggcagcttcccagtgagtaaggt

SEQ ID NO: 7874 - DNA, 24 bp, Artificial Sequence
  Synthetic nucleic acid molecule
aacagtgtcagtgattagtgaggg

SEQ ID NO: 7875 - DNA, 23 bp, Artificial Sequence
  Synthetic nucleic acid molecule
agcttcgtccagagcagtgaggg

SEQ ID NO: 7876 - DNA, 23 bp, Artificial Sequence
  Synthetic nucleic acid molecule
agcagcattgacatgagtgagat

SEQ ID NO: 7877 - DNA, 24 bp, Artificial Sequence
  Synthetic nucleic acid molecule
agcaacgtgatgaaagagtgagat

SEQ ID NO: 7878 - DNA, 24 bp, Artificial Sequence
  Synthetic nucleic acid molecule
agcaatgtcagtctcaagtgtgga

SEQ ID NO: 7879 - DNA, 23 bp, Artificial Sequence
  Synthetic nucleic acid molecule
tgcagtgtccctgggagggaggt

SEQ ID NO: 7880 - DNA, 24 bp, Artificial Sequence
  Synthetic nucleic acid molecule
agcaacggccagtcccagggagga

SEQ ID NO: 7881 - DNA, 23 bp, Artificial Sequence
  Synthetic nucleic acid molecule
agcatcggctcctcaagtgaggc

SEQ ID NO: 7882 - DNA, 23 bp, Artificial Sequence
  Synthetic nucleic acid molecule
agcatcggctcctcaagtgaggc

SEQ ID NO: 7883 - DNA, 23 bp, Artificial Sequence
  Synthetic nucleic acid molecule
agcatcggctcctcaagtgaggc

SEQ ID NO: 7884 - DNA, 23 bp, Artificial Sequence
  Synthetic nucleic acid molecule
agcaaggtcagagagtgtgaggc

SEQ ID NO: 7885 - DNA, 23 bp, Artificial Sequence
  Synthetic nucleic acid molecule
agcggagtccagagaagtgaggg

SEQ ID NO: 7886 - DNA, 23 bp, Artificial Sequence
  Synthetic nucleic acid molecule
agcaccatcagcaccagtgaggt

SEQ ID NO: 7887 - DNA, 23 bp, Artificial Sequence
  Synthetic nucleic acid molecule
agctgcttcccctagagtgagag

SEQ ID NO: 7888 - DNA, 23 bp, Artificial Sequence
  Synthetic nucleic acid molecule
agcaacatcactttgagtaaggc

SEQ ID NO: 7889 - DNA, 23 bp, Artificial Sequence
  Synthetic nucleic acid molecule
aacagtgtcaaatcaagtgaggt

SEQ ID NO: 7890 - DNA, 24 bp, Artificial Sequence
  Synthetic nucleic acid molecule
agcatcgtacctcaagagacagga

SEQ ID NO: 7891 - DNA, 24 bp, Artificial Sequence
  Synthetic nucleic acid molecule
agcatggtcggtttccagtgaggg

SEQ ID NO: 7892 - DNA, 24 bp, Artificial Sequence
  Synthetic nucleic acid molecule
aacagcttcccagcttagtgaggc

SEQ ID NO: 7893 - DNA, 24 bp, Artificial Sequence
  Synthetic nucleic acid molecule
agcaacttccctggagggtgaggg

SEQ ID NO: 7894 - DNA, 23 bp, Artificial Sequence
  Synthetic nucleic acid molecule
agcagcattgacatgagtgagat

SEQ ID NO: 7895 - DNA, 24 bp, Artificial Sequence
  Synthetic nucleic acid molecule
agcagggtggggtgtgagggaggc

SEQ ID NO: 7896 - DNA, 23 bp, Artificial Sequence
  Synthetic nucleic acid molecule
agcattgtctgaaggagagggga

SEQ ID NO: 7897 - DNA, 23 bp, Artificial Sequence
  Synthetic nucleic acid molecule
ggcagcgtgtgtgagagtgagct

SEQ ID NO: 7898 - DNA, 23 bp, Artificial Sequence
  Synthetic nucleic acid molecule
agctgtgtcccccagagtgagag

SEQ ID NO: 7899 - DNA, 23 bp, Artificial Sequence
  Synthetic nucleic acid molecule
agcagcattcatgtgagtgagat

SEQ ID NO: 7900 - DNA, 23 bp, Artificial Sequence
  Synthetic nucleic acid molecule
agcagtgtttctctgagtgtggc

SEQ ID NO: 7901 - DNA, 23 bp, Artificial Sequence
  Synthetic nucleic acid molecule
agcacagtcacccatagtgaggc

SEQ ID NO: 7902 - DNA, 23 bp, Artificial Sequence
  Synthetic nucleic acid molecule
ggcagcttcagggcaaatgagga

SEQ ID NO: 7903 - DNA, 24 bp, Artificial Sequence
  Synthetic nucleic acid molecule
agcattgtcataatagagagaggt

SEQ ID NO: 7904 - DNA, 23 bp, Artificial Sequence
  Synthetic nucleic acid molecule
agcatggtcatggaaagtgagta

SEQ ID NO: 7905 - DNA, 23 bp, Artificial Sequence
  Synthetic nucleic acid molecule
agcagggtggtaaagagggaggt

SEQ ID NO: 7906 - DNA, 23 bp, Artificial Sequence
  Synthetic nucleic acid molecule
agcaacttctccactagtgaggg

SEQ ID NO: 7907 - DNA, 23 bp, Artificial Sequence
  Synthetic nucleic acid molecule
agcagcagccggtggtgtgaggc

SEQ ID NO: 7908 - DNA, 23 bp, Artificial Sequence
  Synthetic nucleic acid molecule
tgcagggtctcttagagtgagtt

SEQ ID NO: 7909 - DNA, 23 bp, Artificial Sequence
  Synthetic nucleic acid molecule
tgcagcgttgggctcagtgaggg

SEQ ID NO: 7910 - DNA, 23 bp, Artificial Sequence
  Synthetic nucleic acid molecule
agcagcatataatagagtgagtc

SEQ ID NO: 7911 - DNA, 23 bp, Artificial Sequence
  Synthetic nucleic acid molecule
agcagtgtgctaaggagagaggc

SEQ ID NO: 7912 - DNA, 24 bp, Artificial Sequence
  Synthetic nucleic acid molecule
aacagcatctcagctgggtgaggc

SEQ ID NO: 7913 - DNA, 24 bp, Artificial Sequence
  Synthetic nucleic acid molecule
agcagtgtgccttgggtgtgaggg

SEQ ID NO: 7914 - DNA, 23 bp, Artificial Sequence
  Synthetic nucleic acid molecule
aacagagtcgttcagtgtgaggc

SEQ ID NO: 7915 - DNA, 23 bp, Artificial Sequence
  Synthetic nucleic acid molecule
agcaacgttagcaggagtgtggt

SEQ ID NO: 7916 - DNA, 24 bp, Artificial Sequence
  Synthetic nucleic acid molecule
agcaaagtctgtaaagagtgtgta

SEQ ID NO: 7917 - DNA, 23 bp, Artificial Sequence
  Synthetic nucleic acid molecule
tgcatcgtcctatggagggaggt

SEQ ID NO: 7918 - DNA, 24 bp, Artificial Sequence
  Synthetic nucleic acid molecule
agcaaggtcttgttggagggaggg

SEQ ID NO: 7919 - DNA, 23 bp, Artificial Sequence
  Synthetic nucleic acid molecule
ggcaccgtcatcctgagtggggc

SEQ ID NO: 7920 - DNA, 24 bp, Artificial Sequence
  Synthetic nucleic acid molecule
agcagagtaagggaggagtgagag

SEQ ID NO: 7921 - DNA, 23 bp, Artificial Sequence
  Synthetic nucleic acid molecule
agcaaagtcacagggagtgagcg

SEQ ID NO: 7922 - DNA, 24 bp, Artificial Sequence
  Synthetic nucleic acid molecule
agaagtgtcactgtccagtgaggc

SEQ ID NO: 7923 - DNA, 23 bp, Artificial Sequence
  Synthetic nucleic acid molecule
agcagcattgacatgagtgagat

SEQ ID NO: 7924 - DNA, 23 bp, Artificial Sequence
  Synthetic nucleic acid molecule
agcaaagtcagccagagggagaa

SEQ ID NO: 7925 - DNA, 24 bp, Artificial Sequence
  Synthetic nucleic acid molecule
agcaaagtctggagtgagtgtgta

SEQ ID NO: 7926 - DNA, 23 bp, Artificial Sequence
  Synthetic nucleic acid molecule
ggcagtgtccggctgagggaggg

SEQ ID NO: 7927 - DNA, 23 bp, Artificial Sequence
  Synthetic nucleic acid molecule
agcagcaacagtgtgagtgagtt

SEQ ID NO: 7928 - DNA, 23 bp, Artificial Sequence
  Synthetic nucleic acid molecule
agcattgtctagcagggtgagaa

SEQ ID NO: 7929 - DNA, 24 bp, Artificial Sequence
  Synthetic nucleic acid molecule
agcaaggtcactgaggagggaggc

SEQ ID NO: 7930 - DNA, 24 bp, Artificial Sequence
  Synthetic nucleic acid molecule
agcatcggcagcttggagagaggt

SEQ ID NO: 7931 - DNA, 24 bp, Artificial Sequence
  Synthetic nucleic acid molecule
agcagggtggtaggggagggaggt

SEQ ID NO: 7932 - DNA, 23 bp, Artificial Sequence
  Synthetic nucleic acid molecule
agcagcgcttctcaaagtgaggc

SEQ ID NO: 7933 - DNA, 24 bp, Artificial Sequence
  Synthetic nucleic acid molecule
agcagggtggtgtgagagtgagtg

SEQ ID NO: 7934 - DNA, 24 bp, Artificial Sequence
  Synthetic nucleic acid molecule
tgcagcgtggccacagagtgagac

SEQ ID NO: 7935 - DNA, 24 bp, Artificial Sequence
  Synthetic nucleic acid molecule
tgcagtgtcatttgagagtaaggt

SEQ ID NO: 7936 - DNA, 24 bp, Artificial Sequence
  Synthetic nucleic acid molecule
agcagggtgagcactaagtgaggc

SEQ ID NO: 7937 - DNA, 24 bp, Artificial Sequence
  Synthetic nucleic acid molecule
aacagggtcagtggggagagaggc

SEQ ID NO: 7938 - DNA, 23 bp, Artificial Sequence
  Synthetic nucleic acid molecule
aacagcggcctattgtgtgaggg

SEQ ID NO: 7939 - DNA, 23 bp, Artificial Sequence
  Synthetic nucleic acid molecule
agcaacgttcagctcagtgaggt

SEQ ID NO: 7940 - DNA, 24 bp, Artificial Sequence
  Synthetic nucleic acid molecule
agcagtgttgccccagggtgaggt

SEQ ID NO: 7941 - DNA, 24 bp, Artificial Sequence
  Synthetic nucleic acid molecule
agcaccgtgtggggagagggaggt

SEQ ID NO: 7942 - DNA, 23 bp, Artificial Sequence
  Synthetic nucleic acid molecule
agcaacgttctgtggaatgagca

SEQ ID NO: 7943 - DNA, 23 bp, Artificial Sequence
  Synthetic nucleic acid molecule
agccacgtcgaatggattgaggg

SEQ ID NO: 7944 - DNA, 24 bp, Artificial Sequence
  Synthetic nucleic acid molecule
agcagggtggagcgcgagggaggc

SEQ ID NO: 7945 - DNA, 23 bp, Artificial Sequence
  Synthetic nucleic acid molecule
tgcagcggcctcagaagtgaggg

SEQ ID NO: 7946 - DNA, 24 bp, Artificial Sequence
  Synthetic nucleic acid molecule
agcattgtctcccttgagtatgga

SEQ ID NO: 7947 - DNA, 23 bp, Artificial Sequence
  Synthetic nucleic acid molecule
ggcaccgtcctttgcagtgaggt

SEQ ID NO: 7948 - DNA, 24 bp, Artificial Sequence
  Synthetic nucleic acid molecule
agcatggtcgggcactagtgaggc

SEQ ID NO: 7949 - DNA, 24 bp, Artificial Sequence
  Synthetic nucleic acid molecule
agcaccttcatgaatgtgtgaggc

SEQ ID NO: 7950 - DNA, 24 bp, Artificial Sequence
  Synthetic nucleic acid molecule
agtagtgtctaataggtgtgaggt

SEQ ID NO: 7951 - DNA, 24 bp, Artificial Sequence
  Synthetic nucleic acid molecule
agcaccatcaagatagtgtgaggc

SEQ ID NO: 7952 - DNA, 23 bp, Artificial Sequence
  Synthetic nucleic acid molecule
agccacgtcacctgaggtgagga

SEQ ID NO: 7953 - DNA, 24 bp, Artificial Sequence
  Synthetic nucleic acid molecule
agcaacatctgtgtagagcgaggt

SEQ ID NO: 7954 - DNA, 23 bp, Artificial Sequence
  Synthetic nucleic acid molecule
agccgagtccttgtgggtgaggc

SEQ ID NO: 7955 - DNA, 24 bp, Artificial Sequence
  Synthetic nucleic acid molecule
accagtgtcctgcagtagtgaggc

SEQ ID NO: 7956 - DNA, 23 bp, Artificial Sequence
  Synthetic nucleic acid molecule
agcaacgacgggctgcgtgtgga

SEQ ID NO: 7957 - DNA, 23 bp, Artificial Sequence
  Synthetic nucleic acid molecule
agcagcattgacctgagtgagat

SEQ ID NO: 7958 - DNA, 23 bp, Artificial Sequence
  Synthetic nucleic acid molecule
agcagcattgacctgagtgagat

SEQ ID NO: 7959 - DNA, 23 bp, Artificial Sequence
  Synthetic nucleic acid molecule
cgcagtgtcttccccagtgaggc

SEQ ID NO: 7960 - DNA, 23 bp, Artificial Sequence
  Synthetic nucleic acid molecule
tgcatcgtcagagagtgtgaggg

SEQ ID NO: 7961 - DNA, 24 bp, Artificial Sequence
  Synthetic nucleic acid molecule
agctgagtccccggcaagtgaggc

SEQ ID NO: 7962 - DNA, 23 bp, Artificial Sequence
  Synthetic nucleic acid molecule
agcaacgtgtgccagtgtgaggg

SEQ ID NO: 7963 - DNA, 24 bp, Artificial Sequence
  Synthetic nucleic acid molecule
agcagtggctgggcatagtgaggc

SEQ ID NO: 7964 - DNA, 23 bp, Artificial Sequence
  Synthetic nucleic acid molecule
agcagcattgacatgagtgagat

SEQ ID NO: 7965 - DNA, 24 bp, Artificial Sequence
  Synthetic nucleic acid molecule
agcaccatctaggcagagggaggc

SEQ ID NO: 7966 - DNA, 24 bp, Artificial Sequence
  Synthetic nucleic acid molecule
agcacagtcatggtggagtaaggg

SEQ ID NO: 7967 - DNA, 24 bp, Artificial Sequence
  Synthetic nucleic acid molecule
agcatggtcaggttccagtgaggg

SEQ ID NO: 7968 - DNA, 24 bp, Artificial Sequence
  Synthetic nucleic acid molecule
agcatggtcaggttccagtgaggg

SEQ ID NO: 7969 - DNA, 24 bp, Artificial Sequence
  Synthetic nucleic acid molecule
agtaacgtcatttcagagtgcaga

SEQ ID NO: 7970 - DNA, 24 bp, Artificial Sequence
  Synthetic nucleic acid molecule
agcaacttctaggatgagtgtgaa

SEQ ID NO: 7971 - DNA, 23 bp, Artificial Sequence
  Synthetic nucleic acid molecule
agcagcattgacatgagtgagat

SEQ ID NO: 7972 - DNA, 24 bp, Artificial Sequence
  Synthetic nucleic acid molecule
agcaatgtctgctgtgggtgaggg

SEQ ID NO: 7973 - DNA, 24 bp, Artificial Sequence
  Synthetic nucleic acid molecule
agcaatgtctgccatgagtgtgaa

SEQ ID NO: 7974 - DNA, 24 bp, Artificial Sequence
  Synthetic nucleic acid molecule
agcagattcggaattgagtgagtg

SEQ ID NO: 7975 - DNA, 23 bp, Artificial Sequence
  Synthetic nucleic acid molecule
cacagcgtcggagggagggaggg

SEQ ID NO: 7976 - DNA, 23 bp, Artificial Sequence
  Synthetic nucleic acid molecule
agcagcgatctaatgagggagaa

SEQ ID NO: 7977 - DNA, 24 bp, Artificial Sequence
  Synthetic nucleic acid molecule
agcaccgtgagacttgagtgagcc

SEQ ID NO: 7978 - DNA, 23 bp, Artificial Sequence
  Synthetic nucleic acid molecule
atcagtgtcctggggagtgtggt

SEQ ID NO: 7979 - DNA, 23 bp, Artificial Sequence
  Synthetic nucleic acid molecule
agcaacctcacggggagggaggc

SEQ ID NO: 7980 - DNA, 24 bp, Artificial Sequence
  Synthetic nucleic acid molecule
agcaacttcagaagtgagttaggg

SEQ ID NO: 7981 - DNA, 23 bp, Artificial Sequence
  Synthetic nucleic acid molecule
agcaacttccactagagagaggc

SEQ ID NO: 7982 - DNA, 24 bp, Artificial Sequence
  Synthetic nucleic acid molecule
agcaacgtggcagatgagagaggt

SEQ ID NO: 7983 - DNA, 24 bp, Artificial Sequence
  Synthetic nucleic acid molecule
aacagcatcaaatgcgggtgaggc

SEQ ID NO: 7984 - DNA, 23 bp, Artificial Sequence
  Synthetic nucleic acid molecule
acaagcgtctgtaagagtgagtc

SEQ ID NO: 7985 - DNA, 23 bp, Artificial Sequence
  Synthetic nucleic acid molecule
tccagcgtcacctaaagtgaggg

SEQ ID NO: 7986 - DNA, 23 bp, Artificial Sequence
  Synthetic nucleic acid molecule
agcaaggtcaggaagagagaggc

SEQ ID NO: 7987 - DNA, 23 bp, Artificial Sequence
  Synthetic nucleic acid molecule
agtagcgttttgtccagtgaggt

SEQ ID NO: 7988 - DNA, 24 bp, Artificial Sequence
  Synthetic nucleic acid molecule
agcagtgtttgctaacagtgaggc

SEQ ID NO: 7989 - DNA, 24 bp, Artificial Sequence
  Synthetic nucleic acid molecule
agcatggtcaggttccagtgaggg

SEQ ID NO: 7990 - DNA, 23 bp, Artificial Sequence
  Synthetic nucleic acid molecule
agcagcggaggtcagagtgagtt

SEQ ID NO: 7991 - DNA, 23 bp, Artificial Sequence
  Synthetic nucleic acid molecule
agcaccgactccatcagtgaggt

SEQ ID NO: 7992 - DNA, 23 bp, Artificial Sequence
  Synthetic nucleic acid molecule
agcagtgacatgaggagtgagcc

SEQ ID NO: 7993 - DNA, 24 bp, Artificial Sequence
  Synthetic nucleic acid molecule
agcagggtttctgcagtgtgaggt

SEQ ID NO: 7994 - DNA, 23 bp, Artificial Sequence
  Synthetic nucleic acid molecule
agcagcatggttaggagtgagat

SEQ ID NO: 7995 - DNA, 23 bp, Artificial Sequence
  Synthetic nucleic acid molecule
atcagagtcaaagggagggaggc

SEQ ID NO: 7996 - DNA, 24 bp, Artificial Sequence
  Synthetic nucleic acid molecule
agcagggttggaagaaagtgaggg

SEQ ID NO: 7997 - DNA, 23 bp, Artificial Sequence
  Synthetic nucleic acid molecule
agcagggtgggcaagagggaggc

SEQ ID NO: 7998 - DNA, 24 bp, Artificial Sequence
  Synthetic nucleic acid molecule
ggcagtgtctcaaacgagggaggg

SEQ ID NO: 7999 - DNA, 24 bp, Artificial Sequence
  Synthetic nucleic acid molecule
ggcatcgtcactcttgagtgagag

SEQ ID NO: 8000 - DNA, 23 bp, Artificial Sequence
  Synthetic nucleic acid molecule
agcaccgtgacttcgagggaggt

SEQ ID NO: 8001 - DNA, 23 bp, Artificial Sequence
  Synthetic nucleic acid molecule
agcagagtttaaaatagtgaggg

SEQ ID NO: 8002 - DNA, 23 bp, Artificial Sequence
  Synthetic nucleic acid molecule
gacagcctcattatgagtgaggc

SEQ ID NO: 8003 - DNA, 24 bp, Artificial Sequence
  Synthetic nucleic acid molecule
aggggggtcttgggagagtgaggt

SEQ ID NO: 8004 - DNA, 23 bp, Artificial Sequence
  Synthetic nucleic acid molecule
agcctggtccgtgagtgtgagga

SEQ ID NO: 8005 - DNA, 24 bp, Artificial Sequence
  Synthetic nucleic acid molecule
ggcagcgatgagattgagtgaggg

SEQ ID NO: 8006 - DNA, 23 bp, Artificial Sequence
  Synthetic nucleic acid molecule
aacaaggtcataaagagggagga

SEQ ID NO: 8007 - DNA, 23 bp, Artificial Sequence
  Synthetic nucleic acid molecule
agctgagacttagagagtgaggt

SEQ ID NO: 8008 - DNA, 23 bp, Artificial Sequence
  Synthetic nucleic acid molecule
agctgagacttagagagtgaggt

SEQ ID NO: 8009 - DNA, 24 bp, Artificial Sequence
  Synthetic nucleic acid molecule
ggcagagtggaggaagagtgaggc

SEQ ID NO: 8010 - DNA, 24 bp, Artificial Sequence
  Synthetic nucleic acid molecule
agctgggttggagtggagtgaggg

SEQ ID NO: 8011 - DNA, 24 bp, Artificial Sequence
  Synthetic nucleic acid molecule
agcaaaggctaaagagtgtgagga

SEQ ID NO: 8012 - DNA, 24 bp, Artificial Sequence
  Synthetic nucleic acid molecule
agtaacggcggggctgagggagga

SEQ ID NO: 8013 - DNA, 23 bp, Artificial Sequence
  Synthetic nucleic acid molecule
agcattgttctcagaagtgagga

SEQ ID NO: 8014 - DNA, 23 bp, Artificial Sequence
  Synthetic nucleic acid molecule
cacagcatcagcaggagtgaggg

SEQ ID NO: 8015 - DNA, 23 bp, Artificial Sequence
  Synthetic nucleic acid molecule
agccacatcagtctgagtaagga

SEQ ID NO: 8016 - DNA, 24 bp, Artificial Sequence
  Synthetic nucleic acid molecule
agcagcacacaggccgagtgaggt

SEQ ID NO: 8017 - DNA, 23 bp, Artificial Sequence
  Synthetic nucleic acid molecule
agcattgccttttggagtgaggg

SEQ ID NO: 8018 - DNA, 24 bp, Artificial Sequence
  Synthetic nucleic acid molecule
agaagtgccatctgggagtgaggg

SEQ ID NO: 8019 - DNA, 23 bp, Artificial Sequence
  Synthetic nucleic acid molecule
atcagcatacaggggagtgaggc

SEQ ID NO: 8020 - DNA, 24 bp, Artificial Sequence
  Synthetic nucleic acid molecule
agcaggtacgtgcctgagtgaggc

SEQ ID NO: 8021 - DNA, 23 bp, Artificial Sequence
  Synthetic nucleic acid molecule
aactacgtccaccagagtgggga

SEQ ID NO: 8022 - DNA, 24 bp, Artificial Sequence
  Synthetic nucleic acid molecule
agaagtgccatctaggagtgaggg

SEQ ID NO: 8023 - DNA, 23 bp, Artificial Sequence
  Synthetic nucleic acid molecule
aggagtctcatactgagtgaggt

SEQ ID NO: 8024 - DNA, 23 bp, Artificial Sequence
  Synthetic nucleic acid molecule
tccagcggccacaggagtgaggt

SEQ ID NO: 8025 - DNA, 23 bp, Artificial Sequence
  Synthetic nucleic acid molecule
agctcagtctcccagggtgagga

SEQ ID NO: 8026 - DNA, 23 bp, Artificial Sequence
  Synthetic nucleic acid molecule
agctcagtctctcagggtgagga

SEQ ID NO: 8027 - DNA, 24 bp, Artificial Sequence
  Synthetic nucleic acid molecule
aacagtatctattctgagtgaggc

SEQ ID NO: 8028 - DNA, 24 bp, Artificial Sequence
  Synthetic nucleic acid molecule
ggaagtgtcttactggagtgaggt

SEQ ID NO: 8029 - DNA, 23 bp, Artificial Sequence
  Synthetic nucleic acid molecule
ctcagagtcaaacagagtgaggt

SEQ ID NO: 8030 - DNA, 24 bp, Artificial Sequence
  Synthetic nucleic acid molecule
aacagtgttttggccgagtgaggg

SEQ ID NO: 8031 - DNA, 23 bp, Artificial Sequence
  Synthetic nucleic acid molecule
ctcagcttcctgtggagtgaggc

SEQ ID NO: 8032 - DNA, 23 bp, Artificial Sequence
  Synthetic nucleic acid molecule
agcagctgtagggagagtgaggt

SEQ ID NO: 8033 - DNA, 23 bp, Artificial Sequence
  Synthetic nucleic acid molecule
agctgtgtgatcctgagtgaggg

SEQ ID NO: 8034 - DNA, 24 bp, Artificial Sequence
  Synthetic nucleic acid molecule
aggtgtgtctttggagagtgaggc

SEQ ID NO: 8035 - DNA, 24 bp, Artificial Sequence
  Synthetic nucleic acid molecule
attagagtctgggttgggtgagga

SEQ ID NO: 8036 - DNA, 24 bp, Artificial Sequence
  Synthetic nucleic acid molecule
agccggctcgcgagtgagtgaggg

SEQ ID NO: 8037 - DNA, 24 bp, Artificial Sequence
  Synthetic nucleic acid molecule
agcaccagcccgggtgagtgaggt

SEQ ID NO: 8038 - DNA, 23 bp, Artificial Sequence
  Synthetic nucleic acid molecule
ttcagcgttgtgaagagtgaggc

SEQ ID NO: 8039 - DNA, 23 bp, Artificial Sequence
  Synthetic nucleic acid molecule
agctccttcgaggagagtgaggc

SEQ ID NO: 8040 - DNA, 24 bp, Artificial Sequence
  Synthetic nucleic acid molecule
aagagtgtcctggttgagtgaggc

SEQ ID NO: 8041 - DNA, 23 bp, Artificial Sequence
  Synthetic nucleic acid molecule
tgcagggtagttgggagtgaggt

SEQ ID NO: 8042 - DNA, 24 bp, Artificial Sequence
  Synthetic nucleic acid molecule
aggatcatccagagtgagtgaggc

SEQ ID NO: 8043 - DNA, 24 bp, Artificial Sequence
  Synthetic nucleic acid molecule
gtctgcgtccgaagggagtgaggg

SEQ ID NO: 8044 - DNA, 23 bp, Artificial Sequence
  Synthetic nucleic acid molecule
atgagcgactgatggagtgaggg

SEQ ID NO: 8045 - DNA, 24 bp, Artificial Sequence
  Synthetic nucleic acid molecule
cccagggtccacagagagtgaggc

SEQ ID NO: 8046 - DNA, 24 bp, Artificial Sequence
  Synthetic nucleic acid molecule
agtacagtccatttggagggagga

SEQ ID NO: 8047 - DNA, 24 bp, Artificial Sequence
  Synthetic nucleic acid molecule
agcttcctccatcttgagtgaggc

SEQ ID NO: 8048 - DNA, 23 bp, Artificial Sequence
  Synthetic nucleic acid molecule
agaagtgcctcctggagtgaggg

SEQ ID NO: 8049 - DNA, 23 bp, Artificial Sequence
  Synthetic nucleic acid molecule
ggcagagtggatcagagtgaggc

SEQ ID NO: 8050 - DNA, 23 bp, Artificial Sequence
  Synthetic nucleic acid molecule
agcagttcctaaaagagtgaggg

SEQ ID NO: 8051 - DNA, 23 bp, Artificial Sequence
  Synthetic nucleic acid molecule
ggcactgtcgctcagagtgaggt

SEQ ID NO: 8052 - DNA, 24 bp, Artificial Sequence
  Synthetic nucleic acid molecule
agcaggcacagcctggagtgaggc

SEQ ID NO: 8053 - DNA, 23 bp, Artificial Sequence
  Synthetic nucleic acid molecule
agtggagtcccctagagtgagaa

SEQ ID NO: 8054 - DNA, 23 bp, Artificial Sequence
  Synthetic nucleic acid molecule
aggacagtcgcagagagtgaggc

SEQ ID NO: 8055 - DNA, 24 bp, Artificial Sequence
  Synthetic nucleic acid molecule
agctgtgtgctgccagagtgaggc

SEQ ID NO: 8056 - DNA, 24 bp, Artificial Sequence
  Synthetic nucleic acid molecule
agcaaggtgggtggcgtgtgagga

SEQ ID NO: 8057 - DNA, 24 bp, Artificial Sequence
  Synthetic nucleic acid molecule
tgctgtgtccccagtgagtgaggg

SEQ ID NO: 8058 - DNA, 23 bp, Artificial Sequence
  Synthetic nucleic acid molecule
ggcacagtctgacagagagagga

SEQ ID NO: 8059 - DNA, 23 bp, Artificial Sequence
  Synthetic nucleic acid molecule
agctcagtctcacagggtgagga

SEQ ID NO: 8060 - DNA, 24 bp, Artificial Sequence
  Synthetic nucleic acid molecule
gtcagtgtcatgcttgagtgaggc

SEQ ID NO: 8061 - DNA, 24 bp, Artificial Sequence
  Synthetic nucleic acid molecule
ggaagggtcccagtggagtgaggt

SEQ ID NO: 8062 - DNA, 23 bp, Artificial Sequence
  Synthetic nucleic acid molecule
aggagcaacaaagagagtgaggg

SEQ ID NO: 8063 - DNA, 23 bp, Artificial Sequence
  Synthetic nucleic acid molecule
agcggtttcagtgagagtgaggc

SEQ ID NO: 8064 - DNA, 23 bp, Artificial Sequence
  Synthetic nucleic acid molecule
agcagcacggggtgaagtgagga

SEQ ID NO: 8065 - DNA, 24 bp, Artificial Sequence
  Synthetic nucleic acid molecule
agaagggtggagaaggagtgaggt

SEQ ID NO: 8066 - DNA, 24 bp, Artificial Sequence
  Synthetic nucleic acid molecule
tgctgtgtccatccagagtgaggg

SEQ ID NO: 8067 - DNA, 23 bp, Artificial Sequence
  Synthetic nucleic acid molecule
agctcagtcaactggggtgagga

SEQ ID NO: 8068 - DNA, 24 bp, Artificial Sequence
  Synthetic nucleic acid molecule
agcaaggttaggttctagtgagga

SEQ ID NO: 8069 - DNA, 23 bp, Artificial Sequence
  Synthetic nucleic acid molecule
agctcagtctctcagggtgagga

SEQ ID NO: 8070 - DNA, 23 bp, Artificial Sequence
  Synthetic nucleic acid molecule
agcacggtggtcaagagtgaggc

SEQ ID NO: 8071 - DNA, 23 bp, Artificial Sequence
  Synthetic nucleic acid molecule
agcagggatttgcagagtgaggc

SEQ ID NO: 8072 - DNA, 24 bp, Artificial Sequence
  Synthetic nucleic acid molecule
atcagctttggggttgagtgaggt

SEQ ID NO: 8073 - DNA, 23 bp, Artificial Sequence
  Synthetic nucleic acid molecule
agcacagacagcatgagtgaggc

SEQ ID NO: 8074 - DNA, 23 bp, Artificial Sequence
  Synthetic nucleic acid molecule
cccagcttctcagggagtgaggc

SEQ ID NO: 8075 - DNA, 23 bp, Artificial Sequence
  Synthetic nucleic acid molecule
cgccccgtctgggaaagtgagga

SEQ ID NO: 8076 - DNA, 23 bp, Artificial Sequence
  Synthetic nucleic acid molecule
agcagaggttcccagagtgaggc

SEQ ID NO: 8077 - DNA, 24 bp, Artificial Sequence
  Synthetic nucleic acid molecule
agccacctcccctgcgagtaagga

SEQ ID NO: 8078 - DNA, 24 bp, Artificial Sequence
  Synthetic nucleic acid molecule
agccctgtctgttaagagtgaggt

SEQ ID NO: 8079 - DNA, 23 bp, Artificial Sequence
  Synthetic nucleic acid molecule
agcagcagtctctggagtgaggt

SEQ ID NO: 8080 - DNA, 24 bp, Artificial Sequence
  Synthetic nucleic acid molecule
agccacttctagggagagtgagta

SEQ ID NO: 8081 - DNA, 23 bp, Artificial Sequence
  Synthetic nucleic acid molecule
aggtgcggcaggtagagtgaggg

SEQ ID NO: 8082 - DNA, 23 bp, Artificial Sequence
  Synthetic nucleic acid molecule
agctgtgtggttgggagtgaggg

SEQ ID NO: 8083 - DNA, 24 bp, Artificial Sequence
  Synthetic nucleic acid molecule
aggcgcttcatttatgagtgaggt

SEQ ID NO: 8084 - DNA, 24 bp, Artificial Sequence
  Synthetic nucleic acid molecule
aggagtctcacgatagagtgaggt

SEQ ID NO: 8085 - DNA, 24 bp, Artificial Sequence
  Synthetic nucleic acid molecule
atcatcctccgcactgagtgaggg

SEQ ID NO: 8086 - DNA, 24 bp, Artificial Sequence
  Synthetic nucleic acid molecule
agccgggtaggggatgagtgaggc

SEQ ID NO: 8087 - DNA, 24 bp, Artificial Sequence
  Synthetic nucleic acid molecule
agcaactgctttgtggagtgaggt

SEQ ID NO: 8088 - DNA, 24 bp, Artificial Sequence
  Synthetic nucleic acid molecule
ggcagcatttgaagggagtgaggg

SEQ ID NO: 8089 - DNA, 24 bp, Artificial Sequence
  Synthetic nucleic acid molecule
cacagcatctgaggtgagtgaggg

SEQ ID NO: 8090 - DNA, 23 bp, Artificial Sequence
  Synthetic nucleic acid molecule
agctgagacttagagagtgaggt

SEQ ID NO: 8091 - DNA, 24 bp, Artificial Sequence
  Synthetic nucleic acid molecule
acccgtgtcacagttgagtgaggg

SEQ ID NO: 8092 - DNA, 24 bp, Artificial Sequence
  Synthetic nucleic acid molecule
agccctgtctgctgggagtgaggg

SEQ ID NO: 8093 - DNA, 23 bp, Artificial Sequence
  Synthetic nucleic acid molecule
ggacgcgtcaggctgagtgaggt

SEQ ID NO: 8094 - DNA, 23 bp, Artificial Sequence
  Synthetic nucleic acid molecule
aggaacctcgtgcggagtgaggc

SEQ ID NO: 8095 - DNA, 23 bp, Artificial Sequence
  Synthetic nucleic acid molecule
agctgtgtggccttgagtgaggc

SEQ ID NO: 8096 - DNA, 23 bp, Artificial Sequence
  Synthetic nucleic acid molecule
cgctgcgaccttcagagtgaggc

SEQ ID NO: 8097 - DNA, 23 bp, Artificial Sequence
  Synthetic nucleic acid molecule
ggtagagtcagacagagtgaggg

SEQ ID NO: 8098 - DNA, 23 bp, Artificial Sequence
  Synthetic nucleic acid molecule
agctgagacttagagagtgaggt

SEQ ID NO: 8099 - DNA, 24 bp, Artificial Sequence
  Synthetic nucleic acid molecule
accaacctcctgtcagagtgaggc

SEQ ID NO: 8100 - DNA, 24 bp, Artificial Sequence
  Synthetic nucleic acid molecule
agcagtctgctgcaggagtgaggg

SEQ ID NO: 8101 - DNA, 24 bp, Artificial Sequence
  Synthetic nucleic acid molecule
tgctgtgtcctcacatagtgagga

SEQ ID NO: 8102 - DNA, 24 bp, Artificial Sequence
  Synthetic nucleic acid molecule
agaaacttcaagaaggagtgaggt

SEQ ID NO: 8103 - DNA, 24 bp, Artificial Sequence
  Synthetic nucleic acid molecule
aacaatgtcgtcacagagtgagta

SEQ ID NO: 8104 - DNA, 24 bp, Artificial Sequence
  Synthetic nucleic acid molecule
agaagggtgaataaggagtgaggt

SEQ ID NO: 8105 - DNA, 23 bp, Artificial Sequence
  Synthetic nucleic acid molecule
tgcagcggaggcaggagtgaggg

SEQ ID NO: 8106 - DNA, 23 bp, Artificial Sequence
  Synthetic nucleic acid molecule
agctgtgtgacctcgagtgaggc

SEQ ID NO: 8107 - DNA, 23 bp, Artificial Sequence
  Synthetic nucleic acid molecule
aatagagtcctggggagtgaggc

SEQ ID NO: 8108 - DNA, 23 bp, Artificial Sequence
  Synthetic nucleic acid molecule
agctgagacttagagagtgaggt

SEQ ID NO: 8109 - DNA, 23 bp, Artificial Sequence
  Synthetic nucleic acid molecule
agctgagacttagagagtgaggt

SEQ ID NO: 8110 - DNA, 24 bp, Artificial Sequence
  Synthetic nucleic acid molecule
agtagcatttttagtgagtgaggg

SEQ ID NO: 8111 - DNA, 24 bp, Artificial Sequence
  Synthetic nucleic acid molecule
accggagtcatccctgagtgaggg

SEQ ID NO: 8112 - DNA, 23 bp, Artificial Sequence
  Synthetic nucleic acid molecule
agcagtctgaaggggagtgaggg

SEQ ID NO: 8113 - DNA, 24 bp, Artificial Sequence
  Synthetic nucleic acid molecule
agcagcacacaggccgagtgaggt

SEQ ID NO: 8114 - DNA, 23 bp, Artificial Sequence
  Synthetic nucleic acid molecule
agcagccatcagaggagtgaggc

SEQ ID NO: 8115 - DNA, 24 bp, Artificial Sequence
  Synthetic nucleic acid molecule
gccagggtccaaatggagtgaggc

SEQ ID NO: 8116 - DNA, 23 bp, Artificial Sequence
  Synthetic nucleic acid molecule
agcatcttagtgatgagtgaggt

SEQ ID NO: 8117 - DNA, 23 bp, Artificial Sequence
  Synthetic nucleic acid molecule
aggagcaacagagagagtgaggg

SEQ ID NO: 8118 - DNA, 24 bp, Artificial Sequence
  Synthetic nucleic acid molecule
agcaggtttattagggagtgaggg

SEQ ID NO: 8119 - DNA, 23 bp, Artificial Sequence
  Synthetic nucleic acid molecule
gacagcctctcccagagtgaggc

SEQ ID NO: 8120 - DNA, 23 bp, Artificial Sequence
  Synthetic nucleic acid molecule
agcagcaatggcaggagtgaggt

SEQ ID NO: 8121 - DNA, 23 bp, Artificial Sequence
  Synthetic nucleic acid molecule
ggcagcggtagagatagtgagga

SEQ ID NO: 8122 - DNA, 23 bp, Artificial Sequence
  Synthetic nucleic acid molecule
agtggagtcctggagagtgagta

SEQ ID NO: 8123 - DNA, 23 bp, Artificial Sequence
  Synthetic nucleic acid molecule
agcctggtctggccgtgtgagga

SEQ ID NO: 8124 - DNA, 24 bp, Artificial Sequence
  Synthetic nucleic acid molecule
agaaccgaccagccagagtgaggg

SEQ ID NO: 8125 - DNA, 23 bp, Artificial Sequence
  Synthetic nucleic acid molecule
agcaacatgacccagagtgaggg

SEQ ID NO: 8126 - DNA, 23 bp, Artificial Sequence
  Synthetic nucleic acid molecule
agctcagtcttgcagggtgagga

SEQ ID NO: 8127 - DNA, 23 bp, Artificial Sequence
  Synthetic nucleic acid molecule
agctcagtctcacagggtgagga

SEQ ID NO: 8128 - DNA, 24 bp, Artificial Sequence
  Synthetic nucleic acid molecule
tgcaatgtcaagcttgagtgagaa

SEQ ID NO: 8129 - DNA, 23 bp, Artificial Sequence
  Synthetic nucleic acid molecule
ggccccgtcacggtgagtgaggg

SEQ ID NO: 8130 - DNA, 23 bp, Artificial Sequence
  Synthetic nucleic acid molecule
agctcagtctcacagggtgagga

SEQ ID NO: 8131 - DNA, 24 bp, Artificial Sequence
  Synthetic nucleic acid molecule
agcaatgtagggagggagtgaggg

SEQ ID NO: 8132 - DNA, 24 bp, Artificial Sequence
  Synthetic nucleic acid molecule
agtaacatcctgtttgtgtgagga

SEQ ID NO: 8133 - DNA, 24 bp, Artificial Sequence
  Synthetic nucleic acid molecule
atcattgtctccactgagtgagaa

SEQ ID NO: 8134 - DNA, 23 bp, Artificial Sequence
  Synthetic nucleic acid molecule
agtagagtttaggggagtgaggg

SEQ ID NO: 8135 - DNA, 24 bp, Artificial Sequence
  Synthetic nucleic acid molecule
agcaggggtcagctggagtgaggg

SEQ ID NO: 8136 - DNA, 24 bp, Artificial Sequence
  Synthetic nucleic acid molecule
tgctgtgtcttcctggagtgaggc

SEQ ID NO: 8137 - DNA, 24 bp, Artificial Sequence
  Synthetic nucleic acid molecule
attagagtcagagcagggtgagga

SEQ ID NO: 8138 - DNA, 23 bp, Artificial Sequence
  Synthetic nucleic acid molecule
agaagggtgagcaagagtgaggt

SEQ ID NO: 8139 - DNA, 24 bp, Artificial Sequence
  Synthetic nucleic acid molecule
ctcagtgtctctgtgaagtgagga

SEQ ID NO: 8140 - DNA, 24 bp, Artificial Sequence
  Synthetic nucleic acid molecule
agctgtgttctggatgagtgaggt

SEQ ID NO: 8141 - DNA, 24 bp, Artificial Sequence
  Synthetic nucleic acid molecule
agtacagtctagccagagggagga

SEQ ID NO: 8142 - DNA, 24 bp, Artificial Sequence
  Synthetic nucleic acid molecule
agccgctttattcaagagtgaggg

SEQ ID NO: 8143 - DNA, 23 bp, Artificial Sequence
  Synthetic nucleic acid molecule
accggtgtcgtcgtgagtgaggg

SEQ ID NO: 8144 - DNA, 23 bp, Artificial Sequence
  Synthetic nucleic acid molecule
agcagtgctgaggcgagtgaggc

SEQ ID NO: 8145 - DNA, 23 bp, Artificial Sequence
  Synthetic nucleic acid molecule
agctcagtctcacagggtgagga

SEQ ID NO: 8146 - DNA, 24 bp, Artificial Sequence
  Synthetic nucleic acid molecule
atctgcatctctcttgagtgaggt

SEQ ID NO: 8147 - DNA, 24 bp, Artificial Sequence
  Synthetic nucleic acid molecule
agcacaatcccccaagagtgaggg

SEQ ID NO: 8148 - DNA, 23 bp, Artificial Sequence
  Synthetic nucleic acid molecule
agctcagtctcacagggtgagga

SEQ ID NO: 8149 - DNA, 23 bp, Artificial Sequence
  Synthetic nucleic acid molecule
atcatcatcttggagagtgaggc

SEQ ID NO: 8150 - DNA, 24 bp, Artificial Sequence
  Synthetic nucleic acid molecule
ggtagagtcactgtagagtgaggg

SEQ ID NO: 8151 - DNA, 24 bp, Artificial Sequence
  Synthetic nucleic acid molecule
agctgtgtgctgggggagtgaggc

SEQ ID NO: 8152 - DNA, 23 bp, Artificial Sequence
  Synthetic nucleic acid molecule
atgagtgtcaggtggagtgaggg

SEQ ID NO: 8153 - DNA, 24 bp, Artificial Sequence
  Synthetic nucleic acid molecule
ggcagagtggtccaggagtgaggc

SEQ ID NO: 8154 - DNA, 24 bp, Artificial Sequence
  Synthetic nucleic acid molecule
aggagtctccagggggagtgaggc

SEQ ID NO: 8155 - DNA, 23 bp, Artificial Sequence
  Synthetic nucleic acid molecule
agccaagtcctgaggggtgagga

SEQ ID NO: 8156 - DNA, 23 bp, Artificial Sequence
  Synthetic nucleic acid molecule
cgctgagtccagaggagtgaggc

SEQ ID NO: 8157 - DNA, 24 bp, Artificial Sequence
  Synthetic nucleic acid molecule
ggctccgtcttatgtgagtgaggc

SEQ ID NO: 8158 - DNA, 23 bp, Artificial Sequence
  Synthetic nucleic acid molecule
agcagcagtgaggagagtgaggc

SEQ ID NO: 8159 - DNA, 23 bp, Artificial Sequence
  Synthetic nucleic acid molecule
agtactgtcaactacagtgagga

SEQ ID NO: 8160 - DNA, 24 bp, Artificial Sequence
  Synthetic nucleic acid molecule
atgagcggccggtaggagtgaggt

SEQ ID NO: 8161 - DNA, 23 bp, Artificial Sequence
  Synthetic nucleic acid molecule
tgcaaggtcaggataagtgagga

SEQ ID NO: 8162 - DNA, 23 bp, Artificial Sequence
  Synthetic nucleic acid molecule
agtacagtcactgttagtgagga

SEQ ID NO: 8163 - DNA, 23 bp, Artificial Sequence
  Synthetic nucleic acid molecule
atcattgtcaggttgagtgagaa

SEQ ID NO: 8164 - DNA, 24 bp, Artificial Sequence
  Synthetic nucleic acid molecule
ctcagcggctgctgtgagtgaggg

SEQ ID NO: 8165 - DNA, 24 bp, Artificial Sequence
  Synthetic nucleic acid molecule
agcagtcccatccaagagtgaggg

SEQ ID NO: 8166 - DNA, 24 bp, Artificial Sequence
  Synthetic nucleic acid molecule
agcacaggctggacagagtgaggt

SEQ ID NO: 8167 - DNA, 24 bp, Artificial Sequence
  Synthetic nucleic acid molecule
agcaaccacctcctggagggagga

SEQ ID NO: 8168 - DNA, 23 bp, Artificial Sequence
  Synthetic nucleic acid molecule
agtaaggtcaaggagagggagga

SEQ ID NO: 8169 - DNA, 23 bp, Artificial Sequence
  Synthetic nucleic acid molecule
cgccccgtctggagaagtgagga

SEQ ID NO: 8170 - DNA, 23 bp, Artificial Sequence
  Synthetic nucleic acid molecule
tgcacagtcacatggtgtgagga

SEQ ID NO: 8171 - DNA, 23 bp, Artificial Sequence
  Synthetic nucleic acid molecule
agcagcaagtggcagagtgaggc

SEQ ID NO: 8172 - DNA, 23 bp, Artificial Sequence
  Synthetic nucleic acid molecule
agctcagtctcacagggtgagga

SEQ ID NO: 8173 - DNA, 23 bp, Artificial Sequence
  Synthetic nucleic acid molecule
ggcagggtttctcagagtgaggt

SEQ ID NO: 8174 - DNA, 23 bp, Artificial Sequence
  Synthetic nucleic acid molecule
aggatggtccttccaagtgagga

SEQ ID NO: 8175 - DNA, 23 bp, Artificial Sequence
  Synthetic nucleic acid molecule
agcaaccccattttgagtgaggg

SEQ ID NO: 8176 - DNA, 24 bp, Artificial Sequence
  Synthetic nucleic acid molecule
agaagccacatcagtgagtgaggg

SEQ ID NO: 8177 - DNA, 24 bp, Artificial Sequence
  Synthetic nucleic acid molecule
accaatgtcacctgtgtgtgagga

SEQ ID NO: 8178 - DNA, 23 bp, Artificial Sequence
  Synthetic nucleic acid molecule
aggtgcgtggagtggagtgaggg

SEQ ID NO: 8179 - DNA, 23 bp, Artificial Sequence
  Synthetic nucleic acid molecule
agcagtgaagggaagagtgaggc

SEQ ID NO: 8180 - DNA, 24 bp, Artificial Sequence
  Synthetic nucleic acid molecule
agctgagtgacagctgagtgaggg

SEQ ID NO: 8181 - DNA, 23 bp, Artificial Sequence
  Synthetic nucleic acid molecule
agcagtgcgtgcatgagtgaggg

SEQ ID NO: 8182 - DNA, 23 bp, Artificial Sequence
  Synthetic nucleic acid molecule
ggcggggtctgctcgagtgaggc

SEQ ID NO: 8183 - DNA, 23 bp, Artificial Sequence
  Synthetic nucleic acid molecule
agaatagtcttagacagtgagga

SEQ ID NO: 8184 - DNA, 23 bp, Artificial Sequence
  Synthetic nucleic acid molecule
agcagggatttgcagagtgaggc

SEQ ID NO: 8185 - DNA, 23 bp, Artificial Sequence
  Synthetic nucleic acid molecule
ggaagtgtccaagggagtgaggt

SEQ ID NO: 8186 - DNA, 24 bp, Artificial Sequence
  Synthetic nucleic acid molecule
atcaatgtcctctgtgagtgaggg

SEQ ID NO: 8187 - DNA, 23 bp, Artificial Sequence
  Synthetic nucleic acid molecule
cccagcttcctggggagtgaggc

SEQ ID NO: 8188 - DNA, 23 bp, Artificial Sequence
  Synthetic nucleic acid molecule
aggtgcggcaggtagagtgaggg

SEQ ID NO: 8189 - DNA, 23 bp, Artificial Sequence
  Synthetic nucleic acid molecule
agctgagacttagagagtgaggt

SEQ ID NO: 8190 - DNA, 23 bp, Artificial Sequence
  Synthetic nucleic acid molecule
agcaacatggctcagagtgaggg

SEQ ID NO: 8191 - DNA, 24 bp, Artificial Sequence
  Synthetic nucleic acid molecule
tgcgccgtctactaggagtgaggc

SEQ ID NO: 8192 - DNA, 24 bp, Artificial Sequence
  Synthetic nucleic acid molecule
agcaaagtttaacaagagtgagaa

SEQ ID NO: 8193 - DNA, 24 bp, Artificial Sequence
  Synthetic nucleic acid molecule
agcaaagtttaacaagagtgagaa

SEQ ID NO: 8194 - DNA, 24 bp, Artificial Sequence
  Synthetic nucleic acid molecule
agcaaagtttaacaagagtgagaa

SEQ ID NO: 8195 - DNA, 24 bp, Artificial Sequence
  Synthetic nucleic acid molecule
agcaaagtttaacaagagtgagaa

SEQ ID NO: 8196 - DNA, 24 bp, Artificial Sequence
  Synthetic nucleic acid molecule
agcaaagtttaacaagagtgagaa

SEQ ID NO: 8197 - DNA, 23 bp, Artificial Sequence
  Synthetic nucleic acid molecule
agtatcatccggctgagtgaggt

SEQ ID NO: 8198 - DNA, 23 bp, Artificial Sequence
  Synthetic nucleic acid molecule
agctgagacttagagagtgaggt

SEQ ID NO: 8199 - DNA, 24 bp, Artificial Sequence
  Synthetic nucleic acid molecule
aggagcaaccacagggagtgaggg

SEQ ID NO: 8200 - DNA, 23 bp, Artificial Sequence
  Synthetic nucleic acid molecule
agcagctcgctgaggagtgaggg

SEQ ID NO: 8201 - DNA, 23 bp, Artificial Sequence
  Synthetic nucleic acid molecule
agctgagacttagagagtgaggt

SEQ ID NO: 8202 - DNA, 24 bp, Artificial Sequence
  Synthetic nucleic acid molecule
agcaatgtgagttgtgagtgaggg

SEQ ID NO: 8203 - DNA, 24 bp, Artificial Sequence
  Synthetic nucleic acid molecule
agaagcggtgcgtctgagtgaggt

SEQ ID NO: 8204 - DNA, 24 bp, Artificial Sequence
  Synthetic nucleic acid molecule
agaagtgccatctgtgagtgaggg

SEQ ID NO: 8205 - DNA, 23 bp, Artificial Sequence
  Synthetic nucleic acid molecule
ggatgagtctggaggagtgagga

SEQ ID NO: 8206 - DNA, 24 bp, Artificial Sequence
  Synthetic nucleic acid molecule
acaggtgtccaagatgagtgagga

SEQ ID NO: 8207 - DNA, 24 bp, Artificial Sequence
  Synthetic nucleic acid molecule
ctgggcgtccctccagagtgagga

SEQ ID NO: 8208 - DNA, 24 bp, Artificial Sequence
  Synthetic nucleic acid molecule
cccggggtcttcagtgagtgagga

SEQ ID NO: 8209 - DNA, 23 bp, Artificial Sequence
  Synthetic nucleic acid molecule
tggcacgtctgagggagtgagga

SEQ ID NO: 8210 - DNA, 24 bp, Artificial Sequence
  Synthetic nucleic acid molecule
agctcagtacaaaaagagtgagga

SEQ ID NO: 8211 - DNA, 23 bp, Artificial Sequence
  Synthetic nucleic acid molecule
aaaaggttcagagggagtgagga

SEQ ID NO: 8212 - DNA, 24 bp, Artificial Sequence
  Synthetic nucleic acid molecule
gacatcatcagaactgagtgagga

SEQ ID NO: 8213 - DNA, 24 bp, Artificial Sequence
  Synthetic nucleic acid molecule
agcactattctattagagtgagga

SEQ ID NO: 8214 - DNA, 23 bp, Artificial Sequence
  Synthetic nucleic acid molecule
ccctgagtctgagggagtgagga

SEQ ID NO: 8215 - DNA, 23 bp, Artificial Sequence
  Synthetic nucleic acid molecule
tggggagtcagtgcgagtgagga

SEQ ID NO: 8216 - DNA, 23 bp, Artificial Sequence
  Synthetic nucleic acid molecule
aacagggcttctgagagtgagga

SEQ ID NO: 8217 - DNA, 23 bp, Artificial Sequence
  Synthetic nucleic acid molecule
agcaaagctcgagagagtgagga

SEQ ID NO: 8218 - DNA, 23 bp, Artificial Sequence
  Synthetic nucleic acid molecule
aacattgtttcagtgagtgagga

SEQ ID NO: 8219 - DNA, 24 bp, Artificial Sequence
  Synthetic nucleic acid molecule
agacacttcatgaatgagtgagga

SEQ ID NO: 8220 - DNA, 24 bp, Artificial Sequence
  Synthetic nucleic acid molecule
gcccacgtcttcgtggagtgagga

SEQ ID NO: 8221 - DNA, 24 bp, Artificial Sequence
  Synthetic nucleic acid molecule
aacatggttgtgtgggagtgagga

SEQ ID NO: 8222 - DNA, 24 bp, Artificial Sequence
  Synthetic nucleic acid molecule
ggtacagtcttcgccgagtgagga

SEQ ID NO: 8223 - DNA, 24 bp, Artificial Sequence
  Synthetic nucleic acid molecule
ggcatggtgagagtggagtgagga

SEQ ID NO: 8224 - DNA, 23 bp, Artificial Sequence
  Synthetic nucleic acid molecule
ggaagtctcaggatgagtgagga

SEQ ID NO: 8225 - DNA, 24 bp, Artificial Sequence
  Synthetic nucleic acid molecule
atcttggtcagggcagagtgagga

SEQ ID NO: 8226 - DNA, 23 bp, Artificial Sequence
  Synthetic nucleic acid molecule
atcaggtcccaattgagtgagga

SEQ ID NO: 8227 - DNA, 24 bp, Artificial Sequence
  Synthetic nucleic acid molecule
ggcatggtgtaaagagagtgagga

SEQ ID NO: 8228 - DNA, 23 bp, Artificial Sequence
  Synthetic nucleic acid molecule
tgaaacgttgcagggagtgagga

SEQ ID NO: 8229 - DNA, 23 bp, Artificial Sequence
  Synthetic nucleic acid molecule
tgaatcggcaacaagagtgagga

SEQ ID NO: 8230 - DNA, 23 bp, Artificial Sequence
  Synthetic nucleic acid molecule
atacacgtctcctggagtgagga

SEQ ID NO: 8231 - DNA, 23 bp, Artificial Sequence
  Synthetic nucleic acid molecule
gggaaggtccttgggagtgagga

SEQ ID NO: 8232 - DNA, 24 bp, Artificial Sequence
  Synthetic nucleic acid molecule
cactgtgtcgggtgagagtgagga

SEQ ID NO: 8233 - DNA, 23 bp, Artificial Sequence
  Synthetic nucleic acid molecule
atctttgtcttcctgagtgagga

SEQ ID NO: 8234 - DNA, 23 bp, Artificial Sequence
  Synthetic nucleic acid molecule
ctgagggtcattgggagtgagga

SEQ ID NO: 8235 - DNA, 23 bp, Artificial Sequence
  Synthetic nucleic acid molecule
atgtgagtcttcttgagtgagga

SEQ ID NO: 8236 - DNA, 24 bp, Artificial Sequence
  Synthetic nucleic acid molecule
aaagtcgtcagctatgagtgagga

SEQ ID NO: 8237 - DNA, 23 bp, Artificial Sequence
  Synthetic nucleic acid molecule
aacaatgttcgcctgagtgagga

SEQ ID NO: 8238 - DNA, 24 bp, Artificial Sequence
  Synthetic nucleic acid molecule
gggaaggtcctatgggagtgagga

SEQ ID NO: 8239 - DNA, 24 bp, Artificial Sequence
  Synthetic nucleic acid molecule
ggatgtgtcttcagggagtgagga

SEQ ID NO: 8240 - DNA, 23 bp, Artificial Sequence
  Synthetic nucleic acid molecule
tccacagtctgggtgagtgagga

SEQ ID NO: 8241 - DNA, 24 bp, Artificial Sequence
  Synthetic nucleic acid molecule
agcaaagctatatgggagtgagga

SEQ ID NO: 8242 - DNA, 24 bp, Artificial Sequence
  Synthetic nucleic acid molecule
ccctgggtcccaggggagtgagga

SEQ ID NO: 8243 - DNA, 24 bp, Artificial Sequence
  Synthetic nucleic acid molecule
gtgagggtctctggagagtgagga

SEQ ID NO: 8244 - DNA, 24 bp, Artificial Sequence
  Synthetic nucleic acid molecule
agccaggttgaaaaggagtgagga

SEQ ID NO: 8245 - DNA, 23 bp, Artificial Sequence
  Synthetic nucleic acid molecule
agcatggcttatgggagtgagga

SEQ ID NO: 8246 - DNA, 23 bp, Artificial Sequence
  Synthetic nucleic acid molecule
agctcaggcagggggagtgagga

SEQ ID NO: 8247 - DNA, 23 bp, Artificial Sequence
  Synthetic nucleic acid molecule
ccctgggtctgctggagtgagga

SEQ ID NO: 8248 - DNA, 23 bp, Artificial Sequence
  Synthetic nucleic acid molecule
agcaacagatgaaggagtgagga

SEQ ID NO: 8249 - DNA, 24 bp, Artificial Sequence
  Synthetic nucleic acid molecule
agcatggctggaatggagtgagga

SEQ ID NO: 8250 - DNA, 24 bp, Artificial Sequence
  Synthetic nucleic acid molecule
agctaagttcttgtagagtgagga

SEQ ID NO: 8251 - DNA, 23 bp, Artificial Sequence
  Synthetic nucleic acid molecule
aactttgtcctgaagagtgagga

SEQ ID NO: 8252 - DNA, 24 bp, Artificial Sequence
  Synthetic nucleic acid molecule
aacatggttccttctgagtgagga

SEQ ID NO: 8253 - DNA, 24 bp, Artificial Sequence
  Synthetic nucleic acid molecule
cgccacggctgggaggagtgagga

SEQ ID NO: 8254 - DNA, 23 bp, Artificial Sequence
  Synthetic nucleic acid molecule
ctcattgtccaggagagtgagga

SEQ ID NO: 8255 - DNA, 24 bp, Artificial Sequence
  Synthetic nucleic acid molecule
ccctgggtcatgtgagagtgagga

SEQ ID NO: 8256 - DNA, 24 bp, Artificial Sequence
  Synthetic nucleic acid molecule
agcaacgtcaaagatcactgatca

SEQ ID NO: 8257 - DNA, 24 bp, Artificial Sequence
  Synthetic nucleic acid molecule
agcagcggcgacagcagaggagga

SEQ ID NO: 8258 - DNA, 24 bp, Artificial Sequence
  Synthetic nucleic acid molecule
agcagcggcaagtgggagtaggat

SEQ ID NO: 8259 - DNA, 24 bp, Artificial Sequence
  Synthetic nucleic acid molecule
agcagcggcggcaccacgtgcgca

SEQ ID NO: 8260 - DNA, 24 bp, Artificial Sequence
  Synthetic nucleic acid molecule
agcaccgtcaatcaggtgcgagtc

SEQ ID NO: 8261 - DNA, 24 bp, Artificial Sequence
  Synthetic nucleic acid molecule
agcaccgtcaagagtcagtgttta

SEQ ID NO: 8262 - DNA, 24 bp, Artificial Sequence
  Synthetic nucleic acid molecule
agcacagtcacctctgagtgacac

SEQ ID NO: 8263 - DNA, 23 bp, Artificial Sequence
  Synthetic nucleic acid molecule
agcaacgtatcgatgagggtaga

SEQ ID NO: 8264 - DNA, 23 bp, Artificial Sequence
  Synthetic nucleic acid molecule
agcatcggcaggcagagtaagtc

SEQ ID NO: 8265 - DNA, 24 bp, Artificial Sequence
  Synthetic nucleic acid molecule
aacaacgtcctgaacgtgagagaa

SEQ ID NO: 8266 - DNA, 24 bp, Artificial Sequence
  Synthetic nucleic acid molecule
agcatagtccgtgtagtgagagaa

SEQ ID NO: 8267 - DNA, 24 bp, Artificial Sequence
  Synthetic nucleic acid molecule
agcatggtcttaatggagtgatag

SEQ ID NO: 8268 - DNA, 24 bp, Artificial Sequence
  Synthetic nucleic acid molecule
agctgtgtctgccttgggtgatgc

SEQ ID NO: 8269 - DNA, 23 bp, Artificial Sequence
  Synthetic nucleic acid molecule
agcaatgtcatgtccagtgagcc

SEQ ID NO: 8270 - DNA, 24 bp, Artificial Sequence
  Synthetic nucleic acid molecule
agcattgtccaaggagagtaagtg

SEQ ID NO: 8271 - DNA, 24 bp, Artificial Sequence
  Synthetic nucleic acid molecule
agcagctgctctcaagagtatggg

SEQ ID NO: 8272 - DNA, 24 bp, Artificial Sequence
  Synthetic nucleic acid molecule
tgcagtgtctggagtgtgtcaggc

SEQ ID NO: 8273 - DNA, 24 bp, Artificial Sequence
  Synthetic nucleic acid molecule
agcattgtcctcctctggtgaggt

SEQ ID NO: 8274 - DNA, 24 bp, Artificial Sequence
  Synthetic nucleic acid molecule
agcattgtcccaaaagtgagggga

SEQ ID NO: 8275 - DNA, 23 bp, Artificial Sequence
  Synthetic nucleic acid molecule
agcaatgtctaccacagtgagac

SEQ ID NO: 8276 - DNA, 24 bp, Artificial Sequence
  Synthetic nucleic acid molecule
agcaacgttctttatgtaagagga

SEQ ID NO: 8277 - DNA, 24 bp, Artificial Sequence
  Synthetic nucleic acid molecule
agcaacttcacttaggcgtgggaa

SEQ ID NO: 8278 - DNA, 24 bp, Artificial Sequence
  Synthetic nucleic acid molecule
aggcgagtctctttagtgtgaggc

SEQ ID NO: 8279 - DNA, 24 bp, Artificial Sequence
  Synthetic nucleic acid molecule
agccacgttaggggtaagtgaggg

SEQ ID NO: 8280 - DNA, 23 bp, Artificial Sequence
  Synthetic nucleic acid molecule
agtatcgtgattgaaagtgaggc

SEQ ID NO: 8281 - DNA, 23 bp, Artificial Sequence
  Synthetic nucleic acid molecule
agcaaggtagcttggagtgagac

SEQ ID NO: 8282 - DNA, 23 bp, Artificial Sequence
  Synthetic nucleic acid molecule
tgcagctgcaaaagaagtgaggg

SEQ ID NO: 8283 - DNA, 24 bp, Artificial Sequence
  Synthetic nucleic acid molecule
agtatcttctggtgtgagtgagat

SEQ ID NO: 8284 - DNA, 24 bp, Artificial Sequence
  Synthetic nucleic acid molecule
tgcagtttctcaaaggagagtgga

SEQ ID NO: 8285 - DNA, 24 bp, Artificial Sequence
  Synthetic nucleic acid molecule
atcaggggcccactagagtaaggg

SEQ ID NO: 8286 - DNA, 24 bp, Artificial Sequence
  Synthetic nucleic acid molecule
agttgcttctgcattgagtaacga

SEQ ID NO: 8287 - DNA, 24 bp, Artificial Sequence
  Synthetic nucleic acid molecule
agctacgtgcccggccagtgaggg

SEQ ID NO: 8288 - DNA, 23 bp, Artificial Sequence
  Synthetic nucleic acid molecule
agcttagtctgagtgtgtgaggt

SEQ ID NO: 8289 - DNA, 23 bp, Artificial Sequence
  Synthetic nucleic acid molecule
atcaggggctgaaggagtaaggg

SEQ ID NO: 8290 - DNA, 23 bp, Artificial Sequence
  Synthetic nucleic acid molecule
atcaggggctgaaggagtaaggg

SEQ ID NO: 8291 - DNA, 24 bp, Artificial Sequence
  Synthetic nucleic acid molecule
agcaacccctctgctgagggaggc

SEQ ID NO: 8292 - DNA, 24 bp, Artificial Sequence
  Synthetic nucleic acid molecule
agcatggtatgatgtaagtgaggg

SEQ ID NO: 8293 - DNA, 24 bp, Artificial Sequence
  Synthetic nucleic acid molecule
catagcgtcagattggagtaaggt

SEQ ID NO: 8294 - DNA, 24 bp, Artificial Sequence
  Synthetic nucleic acid molecule
tgcagctgctgtcagaagtgaggg

SEQ ID NO: 8295 - DNA, 23 bp, Artificial Sequence
  Synthetic nucleic acid molecule
agctaggtcccctgcagtgaggg

SEQ ID NO: 8296 - DNA, 24 bp, Artificial Sequence
  Synthetic nucleic acid molecule
agcttggtcagtgaagagagaggt

SEQ ID NO: 8297 - DNA, 24 bp, Artificial Sequence
  Synthetic nucleic acid molecule
agcaactacatatctgtgtgaggc

SEQ ID NO: 8298 - DNA, 24 bp, Artificial Sequence
  Synthetic nucleic acid molecule
agcaacccctctgctgagggaggc

SEQ ID NO: 8299 - DNA, 24 bp, Artificial Sequence
  Synthetic nucleic acid molecule
gtcagtgtcctggaaaagtgaggg

SEQ ID NO: 8300 - DNA, 24 bp, Artificial Sequence
  Synthetic nucleic acid molecule
tgcagtgtagctggagagggaggt

SEQ ID NO: 8301 - DNA, 24 bp, Artificial Sequence
  Synthetic nucleic acid molecule
ctcatcgtccaggctgagtgagtc

SEQ ID NO: 8302 - DNA, 24 bp, Artificial Sequence
  Synthetic nucleic acid molecule
agtaacatcaagtcatagtgaggc

SEQ ID NO: 8303 - DNA, 24 bp, Artificial Sequence
  Synthetic nucleic acid molecule
agctatgtcctaaagaagtgaggg

SEQ ID NO: 8304 - DNA, 24 bp, Artificial Sequence
  Synthetic nucleic acid molecule
gtccgcgtcttgtttgagtaaggg

SEQ ID NO: 8305 - DNA, 23 bp, Artificial Sequence
  Synthetic nucleic acid molecule
agccttgtcactgaaagtgaggc

SEQ ID NO: 8306 - DNA, 24 bp, Artificial Sequence
  Synthetic nucleic acid molecule
agcacagccacatctgtgtgaggc

SEQ ID NO: 8307 - DNA, 24 bp, Artificial Sequence
  Synthetic nucleic acid molecule
agcaacattctaagcgagtgagtc

SEQ ID NO: 8308 - DNA, 24 bp, Artificial Sequence
  Synthetic nucleic acid molecule
agtgtggtcggagcagagtgaggg

SEQ ID NO: 8309 - DNA, 24 bp, Artificial Sequence
  Synthetic nucleic acid molecule
actaatgtcatgctagagtgaggt

SEQ ID NO: 8310 - DNA, 24 bp, Artificial Sequence
  Synthetic nucleic acid molecule
tacattgtctaggaggagtgaggg

SEQ ID NO: 8311 - DNA, 23 bp, Artificial Sequence
  Synthetic nucleic acid molecule
atcaatggccagatgagtgaggg

SEQ ID NO: 8312 - DNA, 24 bp, Artificial Sequence
  Synthetic nucleic acid molecule
cggggagtcccaggggagtgaggg

SEQ ID NO: 8313 - DNA, 23 bp, Artificial Sequence
  Synthetic nucleic acid molecule
agcaggtcacatcggagtgaggg

SEQ ID NO: 8314 - DNA, 23 bp, Artificial Sequence
  Synthetic nucleic acid molecule
agctaggttggcccgagtgaggc

SEQ ID NO: 8315 - DNA, 24 bp, Artificial Sequence
  Synthetic nucleic acid molecule
agtgtggtcagagagaagtgagga

SEQ ID NO: 8316 - DNA, 24 bp, Artificial Sequence
  Synthetic nucleic acid molecule
agtatggtaacagcagagtgaggg

SEQ ID NO: 8317 - DNA, 23 bp, Artificial Sequence
  Synthetic nucleic acid molecule
atccgtctcttctggtgtgagga

SEQ ID NO: 8318 - DNA, 23 bp, Artificial Sequence
  Synthetic nucleic acid molecule
aacagtattgcaatgagtgaggg

SEQ ID NO: 8319 - DNA, 23 bp, Artificial Sequence
  Synthetic nucleic acid molecule
atcagcagtgaacaaagtgagga

SEQ ID NO: 8320 - DNA, 23 bp, Artificial Sequence
  Synthetic nucleic acid molecule
ggccaagtcagcgggagtgaggc

SEQ ID NO: 8321 - DNA, 23 bp, Artificial Sequence
  Synthetic nucleic acid molecule
gccagtgtttctcagagtgaggt

SEQ ID NO: 8322 - DNA, 24 bp, Artificial Sequence
  Synthetic nucleic acid molecule
atcagggcaggccaggagtgaggg

SEQ ID NO: 8323 - DNA, 23 bp, Artificial Sequence
  Synthetic nucleic acid molecule
agtagatgcagttagagtgaggt

SEQ ID NO: 8324 - DNA, 24 bp, Artificial Sequence
  Synthetic nucleic acid molecule
ggcctggtcaggagggagtgaggg

SEQ ID NO: 8325 - DNA, 24 bp, Artificial Sequence
  Synthetic nucleic acid molecule
agcaactcattctgtgagtgaggg

SEQ ID NO: 8326 - DNA, 24 bp, Artificial Sequence
  Synthetic nucleic acid molecule
gggggagtcttgcgggagtgaggt

SEQ ID NO: 8327 - DNA, 24 bp, Artificial Sequence
  Synthetic nucleic acid molecule
atcagtctagcagcagagtgaggc

SEQ ID NO: 8328 - DNA, 23 bp, Artificial Sequence
  Synthetic nucleic acid molecule
agtagatgcatagggagtgaggt

SEQ ID NO: 8329 - DNA, 24 bp, Artificial Sequence
  Synthetic nucleic acid molecule
accagtggtgggggtgagtgaggt

SEQ ID NO: 8330 - DNA, 23 bp, Artificial Sequence
  Synthetic nucleic acid molecule
ggccttgtcccctagagtgaggg

SEQ ID NO: 8331 - DNA, 24 bp, Artificial Sequence
  Synthetic nucleic acid molecule
ctcattgtcttgctggagtgaggc

SEQ ID NO: 8332 - DNA, 24 bp, Artificial Sequence
  Synthetic nucleic acid molecule
agtatggtaaaaggagagtgaggg

SEQ ID NO: 8333 - DNA, 24 bp, Artificial Sequence
  Synthetic nucleic acid molecule
agagaggtcagggtagagtgaggg

SEQ ID NO: 8334 - DNA, 24 bp, Artificial Sequence
  Synthetic nucleic acid molecule
ggcctggtcagatttgagtgaggg

SEQ ID NO: 8335 - DNA, 24 bp, Artificial Sequence
  Synthetic nucleic acid molecule
tgttgagtccgtatggagtgaggg

SEQ ID NO: 8336 - DNA, 23 bp, Artificial Sequence
  Synthetic nucleic acid molecule
agcaccactgacaggagtgaggg

SEQ ID NO: 8337 - DNA, 23 bp, Artificial Sequence
  Synthetic nucleic acid molecule
aaaacagtcatcctgagtgaggg

SEQ ID NO: 8338 - DNA, 23 bp, Artificial Sequence
  Synthetic nucleic acid molecule
aacagtattaaggagagtgaggg

SEQ ID NO: 8339 - DNA, 23 bp, Artificial Sequence
  Synthetic nucleic acid molecule
gccaacatccacatgagtgaggt

SEQ ID NO: 8340 - DNA, 23 bp, Artificial Sequence
  Synthetic nucleic acid molecule
ggccaagtctctcagagtgaggc

SEQ ID NO: 8341 - DNA, 24 bp, Artificial Sequence
  Synthetic nucleic acid molecule
aaaacagtctttcgagagtgaggg

SEQ ID NO: 8342 - DNA, 23 bp, Artificial Sequence
  Synthetic nucleic acid molecule
aatcccgtcatggagagtgaggt

SEQ ID NO: 8343 - DNA, 23 bp, Artificial Sequence
  Synthetic nucleic acid molecule
ggttacgtccggaaaagtgaggc

SEQ ID NO: 8344 - DNA, 23 bp, Artificial Sequence
  Synthetic nucleic acid molecule
agttacttctataaaagtgaggg

SEQ ID NO: 8345 - DNA, 23 bp, Artificial Sequence
  Synthetic nucleic acid molecule
agttacttccctcaaagtgaggg

SEQ ID NO: 8346 - DNA, 23 bp, Artificial Sequence
  Synthetic nucleic acid molecule
ggcatcgtccactccagtgagga

SEQ ID NO: 8347 - DNA, 23 bp, Artificial Sequence
  Synthetic nucleic acid molecule
atcagggtccagctcagtgaggc

SEQ ID NO: 8348 - DNA, 24 bp, Artificial Sequence
  Synthetic nucleic acid molecule
agctcagtcactcctgagtgaggg

SEQ ID NO: 8349 - DNA, 23 bp, Artificial Sequence
  Synthetic nucleic acid molecule
agctcagtcctggggagtgaggg

SEQ ID NO: 8350 - DNA, 23 bp, Artificial Sequence
  Synthetic nucleic acid molecule
agcatggttttctggagtgaggc

SEQ ID NO: 8351 - DNA, 23 bp, Artificial Sequence
  Synthetic nucleic acid molecule
agatgggtcttgctgagtgaggc

SEQ ID NO: 8352 - DNA, 23 bp, Artificial Sequence
  Synthetic nucleic acid molecule
agatgggtcttgctgagtgaggc

SEQ ID NO: 8353 - DNA, 23 bp, Artificial Sequence
  Synthetic nucleic acid molecule
agcagagtcaggatgaatgagga

SEQ ID NO: 8354 - DNA, 23 bp, Artificial Sequence
  Synthetic nucleic acid molecule
agcagagtcatgaagattgagga

SEQ ID NO: 8355 - DNA, 24 bp, Artificial Sequence
  Synthetic nucleic acid molecule
agcagcgtctgaaagtagagatga

SEQ ID NO: 8356 - DNA, 24 bp, Artificial Sequence
  Synthetic nucleic acid molecule
agcagcgtcagcttcaagtatgga

SEQ ID NO: 8357 - DNA, 24 bp, Artificial Sequence
  Synthetic nucleic acid molecule
agcagcgtcaacatttagtaatga

SEQ ID NO: 8358 - DNA, 24 bp, Artificial Sequence
  Synthetic nucleic acid molecule
agcagcgtcaacatttagtaatga

SEQ ID NO: 8359 - DNA, 24 bp, Artificial Sequence
  Synthetic nucleic acid molecule
agcagtgtcttaggaaagagagga

SEQ ID NO: 8360 - DNA, 24 bp, Artificial Sequence
  Synthetic nucleic acid molecule
agcagcttcagatgggagagagaa

SEQ ID NO: 8361 - DNA, 23 bp, Artificial Sequence
  Synthetic nucleic acid molecule
agcagtgtccagcaaagagagga

SEQ ID NO: 8362 - DNA, 23 bp, Artificial Sequence
  Synthetic nucleic acid molecule
tgcagcgtcaatgtgagtgaaaa

SEQ ID NO: 8363 - DNA, 24 bp, Artificial Sequence
  Synthetic nucleic acid molecule
agcagtgtcaggtatgagagggga

SEQ ID NO: 8364 - DNA, 23 bp, Artificial Sequence
  Synthetic nucleic acid molecule
agcagcttcagggagagtgtggg

SEQ ID NO: 8365 - DNA, 24 bp, Artificial Sequence
  Synthetic nucleic acid molecule
agcagtgtccttgccgaaggagga

SEQ ID NO: 8366 - DNA, 24 bp, Artificial Sequence
  Synthetic nucleic acid molecule
agcagcttcatgaaggagagagaa

SEQ ID NO: 8367 - DNA, 23 bp, Artificial Sequence
  Synthetic nucleic acid molecule
agcagcgtggaggtgagtggggt

SEQ ID NO: 8368 - DNA, 24 bp, Artificial Sequence
  Synthetic nucleic acid molecule
agcagcgttactcaggagagagaa

SEQ ID NO: 8369 - DNA, 23 bp, Artificial Sequence
  Synthetic nucleic acid molecule
agaagcgtcactgagagtgagtt

SEQ ID NO: 8370 - DNA, 23 bp, Artificial Sequence
  Synthetic nucleic acid molecule
agcagcatcttgaggggtgaggc

SEQ ID NO: 8371 - DNA, 23 bp, Artificial Sequence
  Synthetic nucleic acid molecule
agcagcggcacaaagagggacga

SEQ ID NO: 8372 - DNA, 23 bp, Artificial Sequence
  Synthetic nucleic acid molecule
agcatcgtctgaaggggtgagca

SEQ ID NO: 8373 - DNA, 23 bp, Artificial Sequence
  Synthetic nucleic acid molecule
agcagcttccaccagagggagta

SEQ ID NO: 8374 - DNA, 24 bp, Artificial Sequence
  Synthetic nucleic acid molecule
agcagcgttctgtctaagtgaaga

SEQ ID NO: 8375 - DNA, 24 bp, Artificial Sequence
  Synthetic nucleic acid molecule
agcagcatctgcttcgggtgaggc

SEQ ID NO: 8376 - DNA, 23 bp, Artificial Sequence
  Synthetic nucleic acid molecule
agcagggtcggggagggtgagaa

SEQ ID NO: 8377 - DNA, 24 bp, Artificial Sequence
  Synthetic nucleic acid molecule
agcagggtcagctgggagtaagaa

SEQ ID NO: 8378 - DNA, 24 bp, Artificial Sequence
  Synthetic nucleic acid molecule
agcagcgccggaagagagcgaggg

SEQ ID NO: 8379 - DNA, 23 bp, Artificial Sequence
  Synthetic nucleic acid molecule
agcaccgtccctaagactgagca

SEQ ID NO: 8380 - DNA, 24 bp, Artificial Sequence
  Synthetic nucleic acid molecule
agcagagtcacagctgaatgaggc

SEQ ID NO: 8381 - DNA, 24 bp, Artificial Sequence
  Synthetic nucleic acid molecule
agcagcgtggacccaaagagagga

SEQ ID NO: 8382 - DNA, 23 bp, Artificial Sequence
  Synthetic nucleic acid molecule
agcagggtccacatgagtcaggg

SEQ ID NO: 8383 - DNA, 24 bp, Artificial Sequence
  Synthetic nucleic acid molecule
agcagggtcggggtggagggagaa

SEQ ID NO: 8384 - DNA, 24 bp, Artificial Sequence
  Synthetic nucleic acid molecule
ggcagcgtccaggtagactgaggg

SEQ ID NO: 8385 - DNA, 24 bp, Artificial Sequence
  Synthetic nucleic acid molecule
agcagtgtcctaaaggaaggagga

SEQ ID NO: 8386 - DNA, 23 bp, Artificial Sequence
  Synthetic nucleic acid molecule
agcagcctcttctgtaatgagga

SEQ ID NO: 8387 - DNA, 23 bp, Artificial Sequence
  Synthetic nucleic acid molecule
agcagcgttgggaagagagagaa

SEQ ID NO: 8388 - DNA, 24 bp, Artificial Sequence
  Synthetic nucleic acid molecule
agcagcgacagggcagaatgaggc

SEQ ID NO: 8389 - DNA, 23 bp, Artificial Sequence
  Synthetic nucleic acid molecule
agcagagtcgagcaaggtgagga

SEQ ID NO: 8390 - DNA, 24 bp, Artificial Sequence
  Synthetic nucleic acid molecule
agcagcatcgagtggaagtgggga

SEQ ID NO: 8391 - DNA, 23 bp, Artificial Sequence
  Synthetic nucleic acid molecule
agctgagtccagaagagtgggga

SEQ ID NO: 8392 - DNA, 23 bp, Artificial Sequence
  Synthetic nucleic acid molecule
ggcagtgtcagtaggtgtgagga

SEQ ID NO: 8393 - DNA, 23 bp, Artificial Sequence
  Synthetic nucleic acid molecule
agcaacttcagaatgagttagga

SEQ ID NO: 8394 - DNA, 23 bp, Artificial Sequence
  Synthetic nucleic acid molecule
agcatcttcagctatagtgagga

SEQ ID NO: 8395 - DNA, 24 bp, Artificial Sequence
  Synthetic nucleic acid molecule
ggcagggtcacccgaaagtgagga

SEQ ID NO: 8396 - DNA, 24 bp, Artificial Sequence
  Synthetic nucleic acid molecule
agcagtgtgtgcccagagtgagta

SEQ ID NO: 8397 - DNA, 24 bp, Artificial Sequence
  Synthetic nucleic acid molecule
agcagtgtaccatgcgagtgagca

SEQ ID NO: 8398 - DNA, 24 bp, Artificial Sequence
  Synthetic nucleic acid molecule
agctgggtctatttggagtcagga

SEQ ID NO: 8399 - DNA, 23 bp, Artificial Sequence
  Synthetic nucleic acid molecule
agcagcgaggtggggagtgagta

SEQ ID NO: 8400 - DNA, 24 bp, Artificial Sequence
  Synthetic nucleic acid molecule
agcagcttggattcagagtgagaa

SEQ ID NO: 8401 - DNA, 24 bp, Artificial Sequence
  Synthetic nucleic acid molecule
agcagcagcaacgaggagcgagga

SEQ ID NO: 8402 - DNA, 24 bp, Artificial Sequence
  Synthetic nucleic acid molecule
agcaccatctttgaaaagtgagga

SEQ ID NO: 8403 - DNA, 24 bp, Artificial Sequence
  Synthetic nucleic acid molecule
agcagagtttgaattgagttagga

SEQ ID NO: 8404 - DNA, 23 bp, Artificial Sequence
  Synthetic nucleic acid molecule
ggcagggtcaaggaaagtgagga

SEQ ID NO: 8405 - DNA, 24 bp, Artificial Sequence
  Synthetic nucleic acid molecule
ggcagtgtccaggaggtgtgagga

SEQ ID NO: 8406 - DNA, 24 bp, Artificial Sequence
  Synthetic nucleic acid molecule
tgcaacgtcacaagtgagagagga

SEQ ID NO: 8407 - DNA, 24 bp, Artificial Sequence
  Synthetic nucleic acid molecule
aacagtgtctttcaaaagtgagga

SEQ ID NO: 8408 - DNA, 24 bp, Artificial Sequence
  Synthetic nucleic acid molecule
agcagtgtagacccagagtgagca

SEQ ID NO: 8409 - DNA, 23 bp, Artificial Sequence
  Synthetic nucleic acid molecule
agctgtgtccccttgagagagga

SEQ ID NO: 8410 - DNA, 24 bp, Artificial Sequence
  Synthetic nucleic acid molecule
agcagcggaggtggggagggagga

SEQ ID NO: 8411 - DNA, 23 bp, Artificial Sequence
  Synthetic nucleic acid molecule
aacagcttctcattgagtgagta

SEQ ID NO: 8412 - DNA, 24 bp, Artificial Sequence
  Synthetic nucleic acid molecule
agtagagtcaggcctgaatgagga

SEQ ID NO: 8413 - DNA, 23 bp, Artificial Sequence
  Synthetic nucleic acid molecule
agcagcgaagccggaagtgagga

SEQ ID NO: 8414 - DNA, 23 bp, Artificial Sequence
  Synthetic nucleic acid molecule
aactgcgtcccaggaagtgagga

SEQ ID NO: 8415 - DNA, 24 bp, Artificial Sequence
  Synthetic nucleic acid molecule
agaagcctctgctatgagtgaggc

SEQ ID NO: 8416 - DNA, 23 bp, Artificial Sequence
  Synthetic nucleic acid molecule
agcagtgtgcaatggagtgagta

SEQ ID NO: 8417 - DNA, 23 bp, Artificial Sequence
  Synthetic nucleic acid molecule
agtagagtccctgggagtgagca

SEQ ID NO: 8418 - DNA, 24 bp, Artificial Sequence
  Synthetic nucleic acid molecule
ggcagtgtcatgtgtgagggagga

SEQ ID NO: 8419 - DNA, 24 bp, Artificial Sequence
  Synthetic nucleic acid molecule
agcactgtcactgttgagtgatga

SEQ ID NO: 8420 - DNA, 24 bp, Artificial Sequence
  Synthetic nucleic acid molecule
agctgggtctgggaggagtcagga

SEQ ID NO: 8421 - DNA, 24 bp, Artificial Sequence
  Synthetic nucleic acid molecule
agcagctttccaagagagtgagaa

SEQ ID NO: 8422 - DNA, 24 bp, Artificial Sequence
  Synthetic nucleic acid molecule
agcagtgtagacccagagtgagca

SEQ ID NO: 8423 - DNA, 24 bp, Artificial Sequence
  Synthetic nucleic acid molecule
ggcagcgtggggatgcagtgagga

SEQ ID NO: 8424 - DNA, 23 bp, Artificial Sequence
  Synthetic nucleic acid molecule
agcagcagcagagggagcgagga

SEQ ID NO: 8425 - DNA, 23 bp, Artificial Sequence
  Synthetic nucleic acid molecule
agtagcttccctctgtgtgagga

SEQ ID NO: 8426 - DNA, 24 bp, Artificial Sequence
  Synthetic nucleic acid molecule
tgcggcgtctcctgggagtgaaga

SEQ ID NO: 8427 - DNA, 23 bp, Artificial Sequence
  Synthetic nucleic acid molecule
aacagagtctggcagagtgagca

SEQ ID NO: 8428 - DNA, 23 bp, Artificial Sequence
  Synthetic nucleic acid molecule
ggcagcggcctggggagtgtgga

SEQ ID NO: 8429 - DNA, 23 bp, Artificial Sequence
  Synthetic nucleic acid molecule
agcaggctccttgttagtgagga

SEQ ID NO: 8430 - DNA, 24 bp, Artificial Sequence
  Synthetic nucleic acid molecule
atcaccatcatacctgagtgagga

SEQ ID NO: 8431 - DNA, 23 bp, Artificial Sequence
  Synthetic nucleic acid molecule
agcagtttaattctgagtgagga

SEQ ID NO: 8432 - DNA, 23 bp, Artificial Sequence
  Synthetic nucleic acid molecule
aacagcaacaaaaagagtgagga

SEQ ID NO: 8433 - DNA, 23 bp, Artificial Sequence
  Synthetic nucleic acid molecule
agctgagtagaatggagtgagga

SEQ ID NO: 8434 - DNA, 23 bp, Artificial Sequence
  Synthetic nucleic acid molecule
agcaacctggggctgagtgagga

SEQ ID NO: 8435 - DNA, 23 bp, Artificial Sequence
  Synthetic nucleic acid molecule
agcaacctggaaaagagtgagga

SEQ ID NO: 8436 - DNA, 23 bp, Artificial Sequence
  Synthetic nucleic acid molecule
tgcaggctcctgtggagtgagga

SEQ ID NO: 8437 - DNA, 23 bp, Artificial Sequence
  Synthetic nucleic acid molecule
cgcagtatcccactgagtgagga

SEQ ID NO: 8438 - DNA, 23 bp, Artificial Sequence
  Synthetic nucleic acid molecule
agaaacatcagatggagtgagga

SEQ ID NO: 8439 - DNA, 23 bp, Artificial Sequence
  Synthetic nucleic acid molecule
acctgtgtctcctggagtgagga

SEQ ID NO: 8440 - DNA, 24 bp, Artificial Sequence
  Synthetic nucleic acid molecule
ggcagggcctcaagggagtgagga

SEQ ID NO: 8441 - DNA, 24 bp, Artificial Sequence
  Synthetic nucleic acid molecule
agaaacatctaagaggagtgagga

SEQ ID NO: 8442 - DNA, 23 bp, Artificial Sequence
  Synthetic nucleic acid molecule
aggtgcatccctcagagtgagga

SEQ ID NO: 8443 - DNA, 23 bp, Artificial Sequence
  Synthetic nucleic acid molecule
ggcagggccttcttgagtgagga

SEQ ID NO: 8444 - DNA, 23 bp, Artificial Sequence
  Synthetic nucleic acid molecule
ggcagctgctttttgagtgagga

SEQ ID NO: 8445 - DNA, 24 bp, Artificial Sequence
  Synthetic nucleic acid molecule
agcatggcccaggaggagtgagga

SEQ ID NO: 8446 - DNA, 24 bp, Artificial Sequence
  Synthetic nucleic acid molecule
agcagcgtcttcagcaagtggagg

SEQ ID NO: 8447 - DNA, 24 bp, Artificial Sequence
  Synthetic nucleic acid molecule
agcagcgtctggggcagtggagga

SEQ ID NO: 8448 - DNA, 23 bp, Artificial Sequence
  Synthetic nucleic acid molecule
agcagcgtctcatagagttaacc

SEQ ID NO: 8449 - DNA, 23 bp, Artificial Sequence
  Synthetic nucleic acid molecule
agcagcgtccctgaaattgtgca

SEQ ID NO: 8450 - DNA, 24 bp, Artificial Sequence
  Synthetic nucleic acid molecule
agcaacgtcagggaagagggacca

SEQ ID NO: 8451 - DNA, 24 bp, Artificial Sequence
  Synthetic nucleic acid molecule
agcagggtccactcagagggagtc

SEQ ID NO: 8452 - DNA, 23 bp, Artificial Sequence
  Synthetic nucleic acid molecule
agcagcgtgtggctgtgtgtggc

SEQ ID NO: 8453 - DNA, 24 bp, Artificial Sequence
  Synthetic nucleic acid molecule
agcagcgttggctgaaactgaggt

SEQ ID NO: 8454 - DNA, 24 bp, Artificial Sequence
  Synthetic nucleic acid molecule
agcaacgtctccagggactgaagc

SEQ ID NO: 8455 - DNA, 24 bp, Artificial Sequence
  Synthetic nucleic acid molecule
agcagggtcatttaggagtgacat

SEQ ID NO: 8456 - DNA, 24 bp, Artificial Sequence
  Synthetic nucleic acid molecule
agcagtgtcttgtcagagtgtgtc

SEQ ID NO: 8457 - DNA, 24 bp, Artificial Sequence
  Synthetic nucleic acid molecule
agcaacgtcctcaaggaggcaaga

SEQ ID NO: 8458 - DNA, 24 bp, Artificial Sequence
  Synthetic nucleic acid molecule
agcatcgtccacctggcgagaggc

SEQ ID NO: 8459 - DNA, 23 bp, Artificial Sequence
  Synthetic nucleic acid molecule
agcagcttctaacaaagtgagac

SEQ ID NO: 8460 - DNA, 24 bp, Artificial Sequence
  Synthetic nucleic acid molecule
agcaacgtcagggaggagagggca

SEQ ID NO: 8461 - DNA, 23 bp, Artificial Sequence
  Synthetic nucleic acid molecule
agcagcgttttcatgtgtgtgta

SEQ ID NO: 8462 - DNA, 23 bp, Artificial Sequence
  Synthetic nucleic acid molecule
agcagcgtttaactgagtgaaag

SEQ ID NO: 8463 - DNA, 23 bp, Artificial Sequence
  Synthetic nucleic acid molecule
agcagggtcagcaggagggagtc

SEQ ID NO: 8464 - DNA, 23 bp, Artificial Sequence
  Synthetic nucleic acid molecule
agcagtgtcattacgagtgcgac

SEQ ID NO: 8465 - DNA, 23 bp, Artificial Sequence
  Synthetic nucleic acid molecule
agcagtgtcagtgcaagtgcggg

SEQ ID NO: 8466 - DNA, 23 bp, Artificial Sequence
  Synthetic nucleic acid molecule
agcagcttccatcgtggtgtgga

SEQ ID NO: 8467 - DNA, 23 bp, Artificial Sequence
  Synthetic nucleic acid molecule
ggcagcgtctaggggtgtgataa

SEQ ID NO: 8468 - DNA, 23 bp, Artificial Sequence
  Synthetic nucleic acid molecule
agcagcttccggtcgagtgattt

SEQ ID NO: 8469 - DNA, 24 bp, Artificial Sequence
  Synthetic nucleic acid molecule
agcagggtccggcttgtgtgcggc

SEQ ID NO: 8470 - DNA, 23 bp, Artificial Sequence
  Synthetic nucleic acid molecule
agcagcggcaagaagagggtggt

SEQ ID NO: 8471 - DNA, 23 bp, Artificial Sequence
  Synthetic nucleic acid molecule
agcagcctcactcagagtgggac

SEQ ID NO: 8472 - DNA, 24 bp, Artificial Sequence
  Synthetic nucleic acid molecule
agcaacgtctccacagagacaggc

SEQ ID NO: 8473 - DNA, 24 bp, Artificial Sequence
  Synthetic nucleic acid molecule
agcagcgtggggggagtgtggggg

SEQ ID NO: 8474 - DNA, 24 bp, Artificial Sequence
  Synthetic nucleic acid molecule
agcagggtctgcagggactgagag

SEQ ID NO: 8475 - DNA, 23 bp, Artificial Sequence
  Synthetic nucleic acid molecule
agcagtgtcttttccagtaaggt

SEQ ID NO: 8476 - DNA, 24 bp, Artificial Sequence
  Synthetic nucleic acid molecule
agcagcggcaagcacaagcaagga

SEQ ID NO: 8477 - DNA, 24 bp, Artificial Sequence
  Synthetic nucleic acid molecule
agcagcttcctccaggggagaggt

SEQ ID NO: 8478 - DNA, 24 bp, Artificial Sequence
  Synthetic nucleic acid molecule
agcagcttcgcctgctggtgtgga

SEQ ID NO: 8479 - DNA, 24 bp, Artificial Sequence
  Synthetic nucleic acid molecule
agcagcgactcacacaagtgagat

SEQ ID NO: 8480 - DNA, 24 bp, Artificial Sequence
  Synthetic nucleic acid molecule
agcagcggccccagcgagtgtgtc

SEQ ID NO: 8481 - DNA, 24 bp, Artificial Sequence
  Synthetic nucleic acid molecule
agcagtgtctgcaactagtgagct

SEQ ID NO: 8482 - DNA, 24 bp, Artificial Sequence
  Synthetic nucleic acid molecule
agcagcggcctggggacgagagga

SEQ ID NO: 8483 - DNA, 23 bp, Artificial Sequence
  Synthetic nucleic acid molecule
agcagcggctgccagagggtggt

SEQ ID NO: 8484 - DNA, 24 bp, Artificial Sequence
  Synthetic nucleic acid molecule
agcaacgtccattctgaggcaaga

SEQ ID NO: 8485 - DNA, 24 bp, Artificial Sequence
  Synthetic nucleic acid molecule
agcattgtcggattctggtgagga

SEQ ID NO: 8486 - DNA, 23 bp, Artificial Sequence
  Synthetic nucleic acid molecule
agcatggtcacaaagggtgaggt

SEQ ID NO: 8487 - DNA, 23 bp, Artificial Sequence
  Synthetic nucleic acid molecule
agcaacatcacagagagagaggg

SEQ ID NO: 8488 - DNA, 23 bp, Artificial Sequence
  Synthetic nucleic acid molecule
agcaatgtcccttggagtgtggg

SEQ ID NO: 8489 - DNA, 23 bp, Artificial Sequence
  Synthetic nucleic acid molecule
agcagctgccagaggagggaggc

SEQ ID NO: 8490 - DNA, 23 bp, Artificial Sequence
  Synthetic nucleic acid molecule
agctgggtcctagaaagtgaggt

SEQ ID NO: 8491 - DNA, 23 bp, Artificial Sequence
  Synthetic nucleic acid molecule
agcagctgcagtgagagtgagct

SEQ ID NO: 8492 - DNA, 23 bp, Artificial Sequence
  Synthetic nucleic acid molecule
agcattgtcaatgacagtgagaa

SEQ ID NO: 8493 - DNA, 23 bp, Artificial Sequence
  Synthetic nucleic acid molecule
agcaaagtctaagagagtgtggc

SEQ ID NO: 8494 - DNA, 23 bp, Artificial Sequence
  Synthetic nucleic acid molecule
agcagggtggagaagagcgaggg

SEQ ID NO: 8495 - DNA, 24 bp, Artificial Sequence
  Synthetic nucleic acid molecule
atcaacgtcctttgagagaaagga

SEQ ID NO: 8496 - DNA, 23 bp, Artificial Sequence
  Synthetic nucleic acid molecule
agcagcttttttccgagtgagag

SEQ ID NO: 8497 - DNA, 24 bp, Artificial Sequence
  Synthetic nucleic acid molecule
ggcagcgtttcctgtgagcaagga

SEQ ID NO: 8498 - DNA, 23 bp, Artificial Sequence
  Synthetic nucleic acid molecule
agcaccatcaggaggagggaggg

SEQ ID NO: 8499 - DNA, 23 bp, Artificial Sequence
  Synthetic nucleic acid molecule
atcagagtctgcaggcgtgaggc

SEQ ID NO: 8500 - DNA, 24 bp, Artificial Sequence
  Synthetic nucleic acid molecule
agcaccggcctcttggagggaggt

SEQ ID NO: 8501 - DNA, 23 bp, Artificial Sequence
  Synthetic nucleic acid molecule
ggcagggtcagtgggagtgagtc

SEQ ID NO: 8502 - DNA, 24 bp, Artificial Sequence
  Synthetic nucleic acid molecule
agcaccttctcctggtagtgaggc

SEQ ID NO: 8503 - DNA, 24 bp, Artificial Sequence
  Synthetic nucleic acid molecule
agcggtgtcatccaggagtgagcg

SEQ ID NO: 8504 - DNA, 23 bp, Artificial Sequence
  Synthetic nucleic acid molecule
agcaatgtctataaaagtgaggc

SEQ ID NO: 8505 - DNA, 23 bp, Artificial Sequence
  Synthetic nucleic acid molecule
agcagggtaagtacaagtgaggc

SEQ ID NO: 8506 - DNA, 23 bp, Artificial Sequence
  Synthetic nucleic acid molecule
agcaacgtgatcgggagggaggg

SEQ ID NO: 8507 - DNA, 23 bp, Artificial Sequence
  Synthetic nucleic acid molecule
agcagggtagatgggagagaggg

SEQ ID NO: 8508 - DNA, 23 bp, Artificial Sequence
  Synthetic nucleic acid molecule
agcaatgtctgggtgagtgtggg

SEQ ID NO: 8509 - DNA, 23 bp, Artificial Sequence
  Synthetic nucleic acid molecule
agcaatgtctgaaatagtgagta

SEQ ID NO: 8510 - DNA, 24 bp, Artificial Sequence
  Synthetic nucleic acid molecule
tgcagagtcaaggaagagtgagat

SEQ ID NO: 8511 - DNA, 24 bp, Artificial Sequence
  Synthetic nucleic acid molecule
agcatagtctcctaggagagaggc

SEQ ID NO: 8512 - DNA, 23 bp, Artificial Sequence
  Synthetic nucleic acid molecule
agcagggtaatggggagagaggg

SEQ ID NO: 8513 - DNA, 23 bp, Artificial Sequence
  Synthetic nucleic acid molecule
atcaccgtcgaggggagggaggg

SEQ ID NO: 8514 - DNA, 24 bp, Artificial Sequence
  Synthetic nucleic acid molecule
ggcagcttcggtgtccagtgaggc

SEQ ID NO: 8515 - DNA, 24 bp, Artificial Sequence
  Synthetic nucleic acid molecule
agctgggtctcattgcagtgaggt

SEQ ID NO: 8516 - DNA, 23 bp, Artificial Sequence
  Synthetic nucleic acid molecule
agcaacgtactgttaagtgagaa

SEQ ID NO: 8517 - DNA, 23 bp, Artificial Sequence
  Synthetic nucleic acid molecule
agcaaagtcaagaagagtgaaaa

SEQ ID NO: 8518 - DNA, 23 bp, Artificial Sequence
  Synthetic nucleic acid molecule
ggcagggtctctcaaagtgaggt

SEQ ID NO: 8519 - DNA, 24 bp, Artificial Sequence
  Synthetic nucleic acid molecule
tgcagggtcatgcaagtgtgaggt

SEQ ID NO: 8520 - DNA, 24 bp, Artificial Sequence
  Synthetic nucleic acid molecule
agcaaagtcagagctgagtgagcc

SEQ ID NO: 8521 - DNA, 24 bp, Artificial Sequence
  Synthetic nucleic acid molecule
ggcagtgtcatttttgagtaaggg

SEQ ID NO: 8522 - DNA, 23 bp, Artificial Sequence
  Synthetic nucleic acid molecule
agcagctgctgtgggagggaggc

SEQ ID NO: 8523 - DNA, 24 bp, Artificial Sequence
  Synthetic nucleic acid molecule
agcagcggtggtatctagtgaggc

SEQ ID NO: 8524 - DNA, 24 bp, Artificial Sequence
  Synthetic nucleic acid molecule
agcaacatctggaacgagtgaata

SEQ ID NO: 8525 - DNA, 23 bp, Artificial Sequence
  Synthetic nucleic acid molecule
agcagtgtgatcttgagtaaggc

SEQ ID NO: 8526 - DNA, 23 bp, Artificial Sequence
  Synthetic nucleic acid molecule
ggcagcttcagcaccagtgaggc

SEQ ID NO: 8527 - DNA, 24 bp, Artificial Sequence
  Synthetic nucleic acid molecule
agcagagttgcttaagagtgagag

SEQ ID NO: 8528 - DNA, 24 bp, Artificial Sequence
  Synthetic nucleic acid molecule
agcaccttctgccaagagtgagat

SEQ ID NO: 8529 - DNA, 23 bp, Artificial Sequence
  Synthetic nucleic acid molecule
agcagctgcgggcagagtgagct

SEQ ID NO: 8530 - DNA, 24 bp, Artificial Sequence
  Synthetic nucleic acid molecule
agtagagtctttgttgtgtgaggt

SEQ ID NO: 8531 - DNA, 24 bp, Artificial Sequence
  Synthetic nucleic acid molecule
agcatggtcgttggggggtgaggc

SEQ ID NO: 8532 - DNA, 24 bp, Artificial Sequence
  Synthetic nucleic acid molecule
agcattgtctcttgtgtgtgaggt

SEQ ID NO: 8533 - DNA, 24 bp, Artificial Sequence
  Synthetic nucleic acid molecule
atcagagtcaatttgtagtgaggt

SEQ ID NO: 8534 - DNA, 23 bp, Artificial Sequence
  Synthetic nucleic acid molecule
agcagcttagaggggagagaggt

SEQ ID NO: 8535 - DNA, 23 bp, Artificial Sequence
  Synthetic nucleic acid molecule
gacagcgtcctccggggtgaggc

SEQ ID NO: 8536 - DNA, 24 bp, Artificial Sequence
  Synthetic nucleic acid molecule
tgcagagtcagccctgagtgagat

SEQ ID NO: 8537 - DNA, 23 bp, Artificial Sequence
  Synthetic nucleic acid molecule
agcagagttggaaggagtgagag

SEQ ID NO: 8538 - DNA, 23 bp, Artificial Sequence
  Synthetic nucleic acid molecule
agcagggtaggtcagagagaggg

SEQ ID NO: 8539 - DNA, 24 bp, Artificial Sequence
  Synthetic nucleic acid molecule
tgcagtgactgtccagagtgaggc

SEQ ID NO: 8540 - DNA, 23 bp, Artificial Sequence
  Synthetic nucleic acid molecule
agcagaggtgaggtgagtgaggg

SEQ ID NO: 8541 - DNA, 23 bp, Artificial Sequence
  Synthetic nucleic acid molecule
agcagtttaaatttgagtgaggc

SEQ ID NO: 8542 - DNA, 23 bp, Artificial Sequence
  Synthetic nucleic acid molecule
agaaaggtcataatgagtgaggg

SEQ ID NO: 8543 - DNA, 24 bp, Artificial Sequence
  Synthetic nucleic acid molecule
agcacaatcccaaaggagtgaggc

SEQ ID NO: 8544 - DNA, 23 bp, Artificial Sequence
  Synthetic nucleic acid molecule
agcaaaggcaggaggagtgaggt

SEQ ID NO: 8545 - DNA, 23 bp, Artificial Sequence
  Synthetic nucleic acid molecule
agccacatcccctagagtgaggt

SEQ ID NO: 8546 - DNA, 23 bp, Artificial Sequence
  Synthetic nucleic acid molecule
tgctgggtctacaggagtgaggc

SEQ ID NO: 8547 - DNA, 23 bp, Artificial Sequence
  Synthetic nucleic acid molecule
ggcagtgtgagctggagtgaggg

SEQ ID NO: 8548 - DNA, 23 bp, Artificial Sequence
  Synthetic nucleic acid molecule
agtagtgtgctgaagagtgaggg

SEQ ID NO: 8549 - DNA, 24 bp, Artificial Sequence
  Synthetic nucleic acid molecule
tgcatggtcagaggtgagtgaggg

SEQ ID NO: 8550 - DNA, 24 bp, Artificial Sequence
  Synthetic nucleic acid molecule
agcatagtttaggatcagtgagga

SEQ ID NO: 8551 - DNA, 24 bp, Artificial Sequence
  Synthetic nucleic acid molecule
agcagcaggatgagagagtgaggc

SEQ ID NO: 8552 - DNA, 24 bp, Artificial Sequence
  Synthetic nucleic acid molecule
agcaccattaaattggagtgaggc

SEQ ID NO: 8553 - DNA, 23 bp, Artificial Sequence
  Synthetic nucleic acid molecule
atcagggttaagcagagtgaggg

SEQ ID NO: 8554 - DNA, 23 bp, Artificial Sequence
  Synthetic nucleic acid molecule
agcaaagtggagaggagggagga

SEQ ID NO: 8555 - DNA, 24 bp, Artificial Sequence
  Synthetic nucleic acid molecule
agcaacaccaatgaagagtgaaga

SEQ ID NO: 8556 - DNA, 23 bp, Artificial Sequence
  Synthetic nucleic acid molecule
ggcagtggctctgtgagtgaggt

SEQ ID NO: 8557 - DNA, 24 bp, Artificial Sequence
  Synthetic nucleic acid molecule
agtatcggctgtggtgagtgaggg

SEQ ID NO: 8558 - DNA, 24 bp, Artificial Sequence
  Synthetic nucleic acid molecule
ggcagctccgcctccgagtgaggg

SEQ ID NO: 8559 - DNA, 24 bp, Artificial Sequence
  Synthetic nucleic acid molecule
agcaaaggctgggtggagtgaggt

SEQ ID NO: 8560 - DNA, 23 bp, Artificial Sequence
  Synthetic nucleic acid molecule
agcaagttccactggagtgtgga

SEQ ID NO: 8561 - DNA, 23 bp, Artificial Sequence
  Synthetic nucleic acid molecule
agcaaaggcagtcagagtgaggg

SEQ ID NO: 8562 - DNA, 24 bp, Artificial Sequence
  Synthetic nucleic acid molecule
cgcagcaacgctctggagtgaggc

SEQ ID NO: 8563 - DNA, 23 bp, Artificial Sequence
  Synthetic nucleic acid molecule
ggcagcggttgggggagtgaggc

SEQ ID NO: 8564 - DNA, 23 bp, Artificial Sequence
  Synthetic nucleic acid molecule
agcaactgcttttagagtgagca

SEQ ID NO: 8565 - DNA, 23 bp, Artificial Sequence
  Synthetic nucleic acid molecule
agaagagtaaagcagagtgaggt

SEQ ID NO: 8566 - DNA, 24 bp, Artificial Sequence
  Synthetic nucleic acid molecule
agcaacataataacagagtgaggt

SEQ ID NO: 8567 - DNA, 24 bp, Artificial Sequence
  Synthetic nucleic acid molecule
cgcaccttcctgtatgagtgaggc

SEQ ID NO: 8568 - DNA, 23 bp, Artificial Sequence
  Synthetic nucleic acid molecule
gtccgcgtcgcccagagtgagaa

SEQ ID NO: 8569 - DNA, 24 bp, Artificial Sequence
  Synthetic nucleic acid molecule
ggcagtgtgcttgatgagtgaggg

SEQ ID NO: 8570 - DNA, 24 bp, Artificial Sequence
  Synthetic nucleic acid molecule
cccaccgtcctaaagaagtgagga

SEQ ID NO: 8571 - DNA, 24 bp, Artificial Sequence
  Synthetic nucleic acid molecule
aacaacgtgaaaccagagtgaggc

SEQ ID NO: 8572 - DNA, 23 bp, Artificial Sequence
  Synthetic nucleic acid molecule
agcaaccacaaaaaaagtgagga

SEQ ID NO: 8573 - DNA, 24 bp, Artificial Sequence
  Synthetic nucleic acid molecule
agccccttcagcatagagtgaggg

SEQ ID NO: 8574 - DNA, 24 bp, Artificial Sequence
  Synthetic nucleic acid molecule
agccgctgcagcagggagtgaggt

SEQ ID NO: 8575 - DNA, 24 bp, Artificial Sequence
  Synthetic nucleic acid molecule
agccgctgcagcagggagtgaggt

SEQ ID NO: 8576 - DNA, 24 bp, Artificial Sequence
  Synthetic nucleic acid molecule
agccgctgcagcagggagtgaggt

SEQ ID NO: 8577 - DNA, 24 bp, Artificial Sequence
  Synthetic nucleic acid molecule
agccgctgcagcagggagtgaggt

SEQ ID NO: 8578 - DNA, 23 bp, Artificial Sequence
  Synthetic nucleic acid molecule
agaggggtctgcaggagtgaggg

SEQ ID NO: 8579 - DNA, 23 bp, Artificial Sequence
  Synthetic nucleic acid molecule
agcaaaggcaaatagagtgaggg

SEQ ID NO: 8580 - DNA, 23 bp, Artificial Sequence
  Synthetic nucleic acid molecule
ggcaacttccaagaaagtgagga

SEQ ID NO: 8581 - DNA, 24 bp, Artificial Sequence
  Synthetic nucleic acid molecule
gccagcttccatacagagtgaggc

SEQ ID NO: 8582 - DNA, 23 bp, Artificial Sequence
  Synthetic nucleic acid molecule
agaagggtgattaggagtgaggc

SEQ ID NO: 8583 - DNA, 24 bp, Artificial Sequence
  Synthetic nucleic acid molecule
agctacgactcaggagagtgaggt

SEQ ID NO: 8584 - DNA, 23 bp, Artificial Sequence
  Synthetic nucleic acid molecule
agcaaggtgggcgggagtgaggg

SEQ ID NO: 8585 - DNA, 24 bp, Artificial Sequence
  Synthetic nucleic acid molecule
aggagagttagaagagagtgaggt

SEQ ID NO: 8586 - DNA, 24 bp, Artificial Sequence
  Synthetic nucleic acid molecule
tgctccgtcctggctgagtgaggt

SEQ ID NO: 8587 - DNA, 23 bp, Artificial Sequence
  Synthetic nucleic acid molecule
agcactgtttgcccgagtgaggc

SEQ ID NO: 8588 - DNA, 24 bp, Artificial Sequence
  Synthetic nucleic acid molecule
agtaccatcagggctgagtgaggc

SEQ ID NO: 8589 - DNA, 23 bp, Artificial Sequence
  Synthetic nucleic acid molecule
agcagcagggcagtgagtgaggc

SEQ ID NO: 8590 - DNA, 23 bp, Artificial Sequence
  Synthetic nucleic acid molecule
ggcagggaccatatgagtgaggc

SEQ ID NO: 8591 - DNA, 23 bp, Artificial Sequence
  Synthetic nucleic acid molecule
agcaaggttccccggagtgagta

SEQ ID NO: 8592 - DNA, 23 bp, Artificial Sequence
  Synthetic nucleic acid molecule
agcatgggcagggggagtgaggc

SEQ ID NO: 8593 - DNA, 23 bp, Artificial Sequence
  Synthetic nucleic acid molecule
agctgagtagctaagagtgaggc

SEQ ID NO: 8594 - DNA, 24 bp, Artificial Sequence
  Synthetic nucleic acid molecule
agcgacttcatatctgagtgaggt

SEQ ID NO: 8595 - DNA, 23 bp, Artificial Sequence
  Synthetic nucleic acid molecule
aggagagtttaaaggagtgaggt

SEQ ID NO: 8596 - DNA, 24 bp, Artificial Sequence
  Synthetic nucleic acid molecule
gacagcatcagtctggagtgaggg

SEQ ID NO: 8597 - DNA, 23 bp, Artificial Sequence
  Synthetic nucleic acid molecule
agcaactccatttcgagtgaggc

SEQ ID NO: 8598 - DNA, 24 bp, Artificial Sequence
  Synthetic nucleic acid molecule
agtcgcttcactttggagtgagaa

SEQ ID NO: 8599 - DNA, 24 bp, Artificial Sequence
  Synthetic nucleic acid molecule
agtaacatctttactgagggagga

SEQ ID NO: 8600 - DNA, 24 bp, Artificial Sequence
  Synthetic nucleic acid molecule
agcaactgcaatggtgagtgagca

SEQ ID NO: 8601 - DNA, 23 bp, Artificial Sequence
  Synthetic nucleic acid molecule
agcattgtgctaggcagtgagga

SEQ ID NO: 8602 - DNA, 24 bp, Artificial Sequence
  Synthetic nucleic acid molecule
agaaaagtcttgaaggagtgaggg

SEQ ID NO: 8603 - DNA, 23 bp, Artificial Sequence
  Synthetic nucleic acid molecule
ggcagtgtagggaggagtgaggt

SEQ ID NO: 8604 - DNA, 24 bp, Artificial Sequence
  Synthetic nucleic acid molecule
agcaaggtaaaggaggagtgaggt

SEQ ID NO: 8605 - DNA, 23 bp, Artificial Sequence
  Synthetic nucleic acid molecule
agcatctgcagatggagtgaggc

SEQ ID NO: 8606 - DNA, 23 bp, Artificial Sequence
  Synthetic nucleic acid molecule
tgcatagtcttggggagtgaggg

SEQ ID NO: 8607 - DNA, 24 bp, Artificial Sequence
  Synthetic nucleic acid molecule
agaagggtgaggtgggagtgaggc

SEQ ID NO: 8608 - DNA, 23 bp, Artificial Sequence
  Synthetic nucleic acid molecule
agccgagtggttaagagtgaggg

SEQ ID NO: 8609 - DNA, 24 bp, Artificial Sequence
  Synthetic nucleic acid molecule
ctcagggtcattagtgagtgaggg

SEQ ID NO: 8610 - DNA, 23 bp, Artificial Sequence
  Synthetic nucleic acid molecule
aacagggttggcctgagtgaggc

SEQ ID NO: 8611 - DNA, 24 bp, Artificial Sequence
  Synthetic nucleic acid molecule
agcctagtcacacctgagtgaggg

SEQ ID NO: 8612 - DNA, 23 bp, Artificial Sequence
  Synthetic nucleic acid molecule
agcaatgttttgctgagtgagaa

SEQ ID NO: 8613 - DNA, 24 bp, Artificial Sequence
  Synthetic nucleic acid molecule
agcagcaaatctgctgagtgaggt

SEQ ID NO: 8614 - DNA, 24 bp, Artificial Sequence
  Synthetic nucleic acid molecule
agcagtccctgcccagagtgaggc

SEQ ID NO: 8615 - DNA, 23 bp, Artificial Sequence
  Synthetic nucleic acid molecule
tgcaatgtctttgagagtgaggt

SEQ ID NO: 8616 - DNA, 23 bp, Artificial Sequence
  Synthetic nucleic acid molecule
tgcaggttctttgggagtgaggg

SEQ ID NO: 8617 - DNA, 24 bp, Artificial Sequence
  Synthetic nucleic acid molecule
agctaagtctgtaggcagtgagga

SEQ ID NO: 8618 - DNA, 23 bp, Artificial Sequence
  Synthetic nucleic acid molecule
agcatagttgggagcagtgagga

SEQ ID NO: 8619 - DNA, 24 bp, Artificial Sequence
  Synthetic nucleic acid molecule
agcatggtagagactgagtgaggg

SEQ ID NO: 8620 - DNA, 24 bp, Artificial Sequence
  Synthetic nucleic acid molecule
agcaaggactgggctgagtgaggc

SEQ ID NO: 8621 - DNA, 24 bp, Artificial Sequence
  Synthetic nucleic acid molecule
aggtgggtccccagagagtgaggc

SEQ ID NO: 8622 - DNA, 24 bp, Artificial Sequence
  Synthetic nucleic acid molecule
agcagctgtcaatcagagtgaggc

SEQ ID NO: 8623 - DNA, 24 bp, Artificial Sequence
  Synthetic nucleic acid molecule
tgcatggtcctggaggagtgaggg

SEQ ID NO: 8624 - DNA, 23 bp, Artificial Sequence
  Synthetic nucleic acid molecule
agcatagtacttaagagtgaggg

SEQ ID NO: 8625 - DNA, 23 bp, Artificial Sequence
  Synthetic nucleic acid molecule
agcaaggtaattaggagtgagta

SEQ ID NO: 8626 - DNA, 24 bp, Artificial Sequence
  Synthetic nucleic acid molecule
tgcaccttcatgcctgagtgaggg

SEQ ID NO: 8627 - DNA, 24 bp, Artificial Sequence
  Synthetic nucleic acid molecule
agcaccgaggtcggagagtgaggg

SEQ ID NO: 8628 - DNA, 23 bp, Artificial Sequence
  Synthetic nucleic acid molecule
tggagagtcagcaggagtgagta

SEQ ID NO: 8629 - DNA, 24 bp, Artificial Sequence
  Synthetic nucleic acid molecule
agaagagttaggtgggagtgaggt

SEQ ID NO: 8630 - DNA, 23 bp, Artificial Sequence
  Synthetic nucleic acid molecule
atcagggttaggatgagtgaggg

SEQ ID NO: 8631 - DNA, 24 bp, Artificial Sequence
  Synthetic nucleic acid molecule
ggcagtgcccagcaggagtgaggc

SEQ ID NO: 8632 - DNA, 23 bp, Artificial Sequence
  Synthetic nucleic acid molecule
agtaaggtcttaaatagtgagga

SEQ ID NO: 8633 - DNA, 23 bp, Artificial Sequence
  Synthetic nucleic acid molecule
agcagcaggccagtgagtgaggc

SEQ ID NO: 8634 - DNA, 23 bp, Artificial Sequence
  Synthetic nucleic acid molecule
agccatgtgcaagtgagtgagga

SEQ ID NO: 8635 - DNA, 24 bp, Artificial Sequence
  Synthetic nucleic acid molecule
ggtagtgttatgaatgagtgagga

SEQ ID NO: 8636 - DNA, 23 bp, Artificial Sequence
  Synthetic nucleic acid molecule
tacaaagtcgatgagagtgagga

SEQ ID NO: 8637 - DNA, 23 bp, Artificial Sequence
  Synthetic nucleic acid molecule
agccatgtacatgtgagtgagga

SEQ ID NO: 8638 - DNA, 24 bp, Artificial Sequence
  Synthetic nucleic acid molecule
gactgggtctgtcatgagtgagga

SEQ ID NO: 8639 - DNA, 23 bp, Artificial Sequence
  Synthetic nucleic acid molecule
agcacagcagatgagagtgagga

SEQ ID NO: 8640 - DNA, 24 bp, Artificial Sequence
  Synthetic nucleic acid molecule
tgaatagtcttggaagagtgagga

SEQ ID NO: 8641 - DNA, 24 bp, Artificial Sequence
  Synthetic nucleic acid molecule
gtcaggttcacacatgagtgagga

SEQ ID NO: 8642 - DNA, 24 bp, Artificial Sequence
  Synthetic nucleic acid molecule
ggtaaagtctggtcagagtgagga

SEQ ID NO: 8643 - DNA, 23 bp, Artificial Sequence
  Synthetic nucleic acid molecule
agtatagtggcagagagtgagga

SEQ ID NO: 8644 - DNA, 24 bp, Artificial Sequence
  Synthetic nucleic acid molecule
atgggggtcagaggggagtgagga

SEQ ID NO: 8645 - DNA, 23 bp, Artificial Sequence
  Synthetic nucleic acid molecule
cccaaagtcgtaaggagtgagga

SEQ ID NO: 8646 - DNA, 23 bp, Artificial Sequence
  Synthetic nucleic acid molecule
caaatcgtctacatgagtgagga

SEQ ID NO: 8647 - DNA, 24 bp, Artificial Sequence
  Synthetic nucleic acid molecule
aataaggtcatagcagagtgagga

SEQ ID NO: 8648 - DNA, 23 bp, Artificial Sequence
  Synthetic nucleic acid molecule
agtatagttcagatgagtgagga

SEQ ID NO: 8649 - DNA, 23 bp, Artificial Sequence
  Synthetic nucleic acid molecule
agagaggtcaaggagagtgagga

SEQ ID NO: 8650 - DNA, 23 bp, Artificial Sequence
  Synthetic nucleic acid molecule
tggtgagtcaccacgagtgagga

SEQ ID NO: 8651 - DNA, 24 bp, Artificial Sequence
  Synthetic nucleic acid molecule
tgcctggtcacttgggagtgagga

SEQ ID NO: 8652 - DNA, 23 bp, Artificial Sequence
  Synthetic nucleic acid molecule
agccatgtgggaaggagtgagga

SEQ ID NO: 8653 - DNA, 24 bp, Artificial Sequence
  Synthetic nucleic acid molecule
aacaaggttcgcagagagtgagga

SEQ ID NO: 8654 - DNA, 24 bp, Artificial Sequence
  Synthetic nucleic acid molecule
agcaatttatgtacagagtgagga

SEQ ID NO: 8655 - DNA, 24 bp, Artificial Sequence
  Synthetic nucleic acid molecule
aggcatgtctcagcagagtgagga

SEQ ID NO: 8656 - DNA, 23 bp, Artificial Sequence
  Synthetic nucleic acid molecule
tacaaagtccttaggagtgagga

SEQ ID NO: 8657 - DNA, 24 bp, Artificial Sequence
  Synthetic nucleic acid molecule
aataaggtcagagaggagtgagga

SEQ ID NO: 8658 - DNA, 24 bp, Artificial Sequence
  Synthetic nucleic acid molecule
aataaagtcagataggagtgagga

SEQ ID NO: 8659 - DNA, 24 bp, Artificial Sequence
  Synthetic nucleic acid molecule
aataaggtcagataggagtgagga

SEQ ID NO: 8660 - DNA, 24 bp, Artificial Sequence
  Synthetic nucleic acid molecule
aataaggtcaaataggagtgagga

SEQ ID NO: 8661 - DNA, 23 bp, Artificial Sequence
  Synthetic nucleic acid molecule
aataaggtcagatggagtgagga

SEQ ID NO: 8662 - DNA, 24 bp, Artificial Sequence
  Synthetic nucleic acid molecule
aataaggtcagataggagtgagga

SEQ ID NO: 8663 - DNA, 23 bp, Artificial Sequence
  Synthetic nucleic acid molecule
agcacagcaggcaggagtgagga

SEQ ID NO: 8664 - DNA, 24 bp, Artificial Sequence
  Synthetic nucleic acid molecule
ggaaaggtcagttatgagtgagga

SEQ ID NO: 8665 - DNA, 23 bp, Artificial Sequence
  Synthetic nucleic acid molecule
agccatttcaacaagagtgagga

SEQ ID NO: 8666 - DNA, 24 bp, Artificial Sequence
  Synthetic nucleic acid molecule
aataaggtcacggtggagtgagga

SEQ ID NO: 8667 - DNA, 23 bp, Artificial Sequence
  Synthetic nucleic acid molecule
atcagcacttcagagagtgagga

SEQ ID NO: 8668 - DNA, 23 bp, Artificial Sequence
  Synthetic nucleic acid molecule
ggtggggtcatggagagtgagga

SEQ ID NO: 8669 - DNA, 24 bp, Artificial Sequence
  Synthetic nucleic acid molecule
cacacagtcagtgtagagtgagga

SEQ ID NO: 8670 - DNA, 23 bp, Artificial Sequence
  Synthetic nucleic acid molecule
aatattgtctctgtgagtgagga

SEQ ID NO: 8671 - DNA, 24 bp, Artificial Sequence
  Synthetic nucleic acid molecule
ggaatagtctggttagagtgagga

SEQ ID NO: 8672 - DNA, 23 bp, Artificial Sequence
  Synthetic nucleic acid molecule
agcaacaatcgtacgagtgagga

SEQ ID NO: 8673 - DNA, 24 bp, Artificial Sequence
  Synthetic nucleic acid molecule
aataaggtcacagtggagtgagga

SEQ ID NO: 8674 - DNA, 23 bp, Artificial Sequence
  Synthetic nucleic acid molecule
gactgtgtccttcagagtgagga

SEQ ID NO: 8675 - DNA, 24 bp, Artificial Sequence
  Synthetic nucleic acid molecule
aataaagtcagataggagtgagga

SEQ ID NO: 8676 - DNA, 24 bp, Artificial Sequence
  Synthetic nucleic acid molecule
aataaggtcagagaggagtgagga

SEQ ID NO: 8677 - DNA, 24 bp, Artificial Sequence
  Synthetic nucleic acid molecule
aataaggtcagacaagagtgagga

SEQ ID NO: 8678 - DNA, 24 bp, Artificial Sequence
  Synthetic nucleic acid molecule
aataaggtcagataggagtgagga

SEQ ID NO: 8679 - DNA, 23 bp, Artificial Sequence
  Synthetic nucleic acid molecule
aataaggtcagatggagtgagga

SEQ ID NO: 8680 - DNA, 23 bp, Artificial Sequence
  Synthetic nucleic acid molecule
agcagcttcccctgcagaaaggt

SEQ ID NO: 8681 - DNA, 23 bp, Artificial Sequence
  Synthetic nucleic acid molecule
ggcaacgtcatctctagtgagac

SEQ ID NO: 8682 - DNA, 24 bp, Artificial Sequence
  Synthetic nucleic acid molecule
agcagtttcttttacttgtgaggg

SEQ ID NO: 8683 - DNA, 24 bp, Artificial Sequence
  Synthetic nucleic acid molecule
agcagtttcagtatcttgtgaggg

SEQ ID NO: 8684 - DNA, 23 bp, Artificial Sequence
  Synthetic nucleic acid molecule
agcagcagccgaacgagggagat

SEQ ID NO: 8685 - DNA, 23 bp, Artificial Sequence
  Synthetic nucleic acid molecule
agcagcagcccagggagggagat

SEQ ID NO: 8686 - DNA, 23 bp, Artificial Sequence
  Synthetic nucleic acid molecule
agcaacttctctaattgtgaggt

SEQ ID NO: 8687 - DNA, 23 bp, Artificial Sequence
  Synthetic nucleic acid molecule
agcaacttccacagttgtgaggt

SEQ ID NO: 8688 - DNA, 23 bp, Artificial Sequence
  Synthetic nucleic acid molecule
agcaaggtcagtgatagtgaata

SEQ ID NO: 8689 - DNA, 24 bp, Artificial Sequence
  Synthetic nucleic acid molecule
agcagtttcggtgttttgtgaggg

SEQ ID NO: 8690 - DNA, 23 bp, Artificial Sequence
  Synthetic nucleic acid molecule
agcagcagcaggaagagggagat

SEQ ID NO: 8691 - DNA, 23 bp, Artificial Sequence
  Synthetic nucleic acid molecule
agcattgtcttagaaagtaaggg

SEQ ID NO: 8692 - DNA, 23 bp, Artificial Sequence
  Synthetic nucleic acid molecule
agcccagtctcagggagtgagag

SEQ ID NO: 8693 - DNA, 24 bp, Artificial Sequence
  Synthetic nucleic acid molecule
agctacatctgcattgagtgagtc

SEQ ID NO: 8694 - DNA, 24 bp, Artificial Sequence
  Synthetic nucleic acid molecule
agcatggtttgaaaggagtgagcc

SEQ ID NO: 8695 - DNA, 24 bp, Artificial Sequence
  Synthetic nucleic acid molecule
gacagggtccacttggagtgagtc

SEQ ID NO: 8696 - DNA, 23 bp, Artificial Sequence
  Synthetic nucleic acid molecule
atcctcgtcctgcagagtgagtc

SEQ ID NO: 8697 - DNA, 23 bp, Artificial Sequence
  Synthetic nucleic acid molecule
cagagcgtccaggtgagtgagtc

SEQ ID NO: 8698 - DNA, 24 bp, Artificial Sequence
  Synthetic nucleic acid molecule
agcaaaggcctgaaggagtaaggg

SEQ ID NO: 8699 - DNA, 23 bp, Artificial Sequence
  Synthetic nucleic acid molecule
agcatcgattaaaagagtgagag

SEQ ID NO: 8700 - DNA, 23 bp, Artificial Sequence
  Synthetic nucleic acid molecule
atcatggtcactttgagggaggg

SEQ ID NO: 8701 - DNA, 24 bp, Artificial Sequence
  Synthetic nucleic acid molecule
agcccagtccccctagagtgagag

SEQ ID NO: 8702 - DNA, 23 bp, Artificial Sequence
  Synthetic nucleic acid molecule
tgcatagtcaatttgagtgagat

SEQ ID NO: 8703 - DNA, 23 bp, Artificial Sequence
  Synthetic nucleic acid molecule
agccatgtcagcttgagggaggt

SEQ ID NO: 8704 - DNA, 24 bp, Artificial Sequence
  Synthetic nucleic acid molecule
agcattgtaggggacgagtgtggt

SEQ ID NO: 8705 - DNA, 23 bp, Artificial Sequence
  Synthetic nucleic acid molecule
atcatggtccaggagagggaggg

SEQ ID NO: 8706 - DNA, 23 bp, Artificial Sequence
  Synthetic nucleic acid molecule
agcaaaggccaagtgagtaaggg

SEQ ID NO: 8707 - DNA, 24 bp, Artificial Sequence
  Synthetic nucleic acid molecule
ataagagtcatgcaggagtgagtg

SEQ ID NO: 8708 - DNA, 24 bp, Artificial Sequence
  Synthetic nucleic acid molecule
agccatgtcccaagggagggaggt

SEQ ID NO: 8709 - DNA, 23 bp, Artificial Sequence
  Synthetic nucleic acid molecule
agcaaaggcaatgagagtaaggg

SEQ ID NO: 8710 - DNA, 23 bp, Artificial Sequence
  Synthetic nucleic acid molecule
agcccagtcaggatgagtgagag

SEQ ID NO: 8711 - DNA, 23 bp, Artificial Sequence
  Synthetic nucleic acid molecule
ttccacgtcaacatgagtgaggg

SEQ ID NO: 8712 - DNA, 24 bp, Artificial Sequence
  Synthetic nucleic acid molecule
agtcaggtccccacagagtgaggt

SEQ ID NO: 8713 - DNA, 23 bp, Artificial Sequence
  Synthetic nucleic acid molecule
ctgagggtcggtaggagtgaggc

SEQ ID NO: 8714 - DNA, 24 bp, Artificial Sequence
  Synthetic nucleic acid molecule
atgacagtctatgcagagtgaggc

SEQ ID NO: 8715 - DNA, 23 bp, Artificial Sequence
  Synthetic nucleic acid molecule
aacagtctacctgagagtgaggc

SEQ ID NO: 8716 - DNA, 23 bp, Artificial Sequence
  Synthetic nucleic acid molecule
ctcagtttcctgaggagtgaggg

SEQ ID NO: 8717 - DNA, 24 bp, Artificial Sequence
  Synthetic nucleic acid molecule
agtcaggtcttccatgagtgaggg

SEQ ID NO: 8718 - DNA, 24 bp, Artificial Sequence
  Synthetic nucleic acid molecule
gtgggcgtccactaagagtgaggc

SEQ ID NO: 8719 - DNA, 24 bp, Artificial Sequence
  Synthetic nucleic acid molecule
ggtggggtccttgaagagtgaggc

SEQ ID NO: 8720 - DNA, 24 bp, Artificial Sequence
  Synthetic nucleic acid molecule
agttaagtctctagagagtgaggg

SEQ ID NO: 8721 - DNA, 24 bp, Artificial Sequence
  Synthetic nucleic acid molecule
ttcaccttccaccatgagtgaggc

SEQ ID NO: 8722 - DNA, 24 bp, Artificial Sequence
  Synthetic nucleic acid molecule
tcctgagtcttggtagagtgaggc

SEQ ID NO: 8723 - DNA, 23 bp, Artificial Sequence
  Synthetic nucleic acid molecule
ataatagtctccatgagtgaggc

SEQ ID NO: 8724 - DNA, 24 bp, Artificial Sequence
  Synthetic nucleic acid molecule
agcaaaggtggggtggagtgaggt

SEQ ID NO: 8725 - DNA, 23 bp, Artificial Sequence
  Synthetic nucleic acid molecule
agtttagtccttgggagtgaggt

SEQ ID NO: 8726 - DNA, 23 bp, Artificial Sequence
  Synthetic nucleic acid molecule
acaaaggtcctccagagtgaggc

SEQ ID NO: 8727 - DNA, 23 bp, Artificial Sequence
  Synthetic nucleic acid molecule
tgcagtcccaatcagagtgaggt

SEQ ID NO: 8728 - DNA, 23 bp, Artificial Sequence
  Synthetic nucleic acid molecule
agtcatgtcgttaagagtgaggc

SEQ ID NO: 8729 - DNA, 24 bp, Artificial Sequence
  Synthetic nucleic acid molecule
caccacgtcaaggtagagagagga

SEQ ID NO: 8730 - DNA, 24 bp, Artificial Sequence
  Synthetic nucleic acid molecule
ctcagtttcaaaagcgagtgaggg

SEQ ID NO: 8731 - DNA, 24 bp, Artificial Sequence
  Synthetic nucleic acid molecule
gaaagtgtccaagtggagtgaggc

SEQ ID NO: 8732 - DNA, 24 bp, Artificial Sequence
  Synthetic nucleic acid molecule
gggtgggtctagagggagtgaggt

SEQ ID NO: 8733 - DNA, 24 bp, Artificial Sequence
  Synthetic nucleic acid molecule
agagttgtcccccaagagtgaggc

SEQ ID NO: 8734 - DNA, 23 bp, Artificial Sequence
  Synthetic nucleic acid molecule
agaaggggtaggaggagtgagag

SEQ ID NO: 8735 - DNA, 23 bp, Artificial Sequence
  Synthetic nucleic acid molecule
agcagagtcatattgagtcaggg

SEQ ID NO: 8736 - DNA, 23 bp, Artificial Sequence
  Synthetic nucleic acid molecule
accatcttcatcaggagtgagga

SEQ ID NO: 8737 - DNA, 23 bp, Artificial Sequence
  Synthetic nucleic acid molecule
aggaacgtctccaagggtgaggg

SEQ ID NO: 8738 - DNA, 23 bp, Artificial Sequence
  Synthetic nucleic acid molecule
agcaccttcagagggagtgtggc

SEQ ID NO: 8739 - DNA, 23 bp, Artificial Sequence
  Synthetic nucleic acid molecule
ggcagggtcggtcagagtgagag

SEQ ID NO: 8740 - DNA, 24 bp, Artificial Sequence
  Synthetic nucleic acid molecule
ggcagggtcacaggtgagtgagag

SEQ ID NO: 8741 - DNA, 23 bp, Artificial Sequence
  Synthetic nucleic acid molecule
agcacagtcaagctgagggaggt

SEQ ID NO: 8742 - DNA, 24 bp, Artificial Sequence
  Synthetic nucleic acid molecule
ggcagggtctaggcagagtgagag

SEQ ID NO: 8743 - DNA, 24 bp, Artificial Sequence
  Synthetic nucleic acid molecule
agcaaggtctactcggggtgaggc

SEQ ID NO: 8744 - DNA, 24 bp, Artificial Sequence
  Synthetic nucleic acid molecule
agcaagttccgttaagagtgaggt

SEQ ID NO: 8745 - DNA, 24 bp, Artificial Sequence
  Synthetic nucleic acid molecule
agcagtttttgcagtgagtgaggc

SEQ ID NO: 8746 - DNA, 23 bp, Artificial Sequence
  Synthetic nucleic acid molecule
agctgcgtcacatggactgagga

SEQ ID NO: 8747 - DNA, 24 bp, Artificial Sequence
  Synthetic nucleic acid molecule
agcagggtctgagctgtgtgggga

SEQ ID NO: 8748 - DNA, 23 bp, Artificial Sequence
  Synthetic nucleic acid molecule
agcagggtcagctggtgtgggga

SEQ ID NO: 8749 - DNA, 24 bp, Artificial Sequence
  Synthetic nucleic acid molecule
agaagcctcaaggatgagtgaggt

SEQ ID NO: 8750 - DNA, 24 bp, Artificial Sequence
  Synthetic nucleic acid molecule
agaagcctcataagtgagtgaggt

SEQ ID NO: 8751 - DNA, 23 bp, Artificial Sequence
  Synthetic nucleic acid molecule
agcattttcaatttgagtgagga

SEQ ID NO: 8752 - DNA, 23 bp, Artificial Sequence
  Synthetic nucleic acid molecule
agcagcgtccctccgacactgga

SEQ ID NO: 8753 - DNA, 24 bp, Artificial Sequence
  Synthetic nucleic acid molecule
agcagtgtcaccgacaggtgaggc

SEQ ID NO: 8754 - DNA, 23 bp, Artificial Sequence
  Synthetic nucleic acid molecule
agcagtgtctgggagagggtaga

SEQ ID NO: 8755 - DNA, 23 bp, Artificial Sequence
  Synthetic nucleic acid molecule
agcaacttcttcctgggtgaggc

SEQ ID NO: 8756 - DNA, 24 bp, Artificial Sequence
  Synthetic nucleic acid molecule
agcccggtctgaaaggagtgaaga

SEQ ID NO: 8757 - DNA, 24 bp, Artificial Sequence
  Synthetic nucleic acid molecule
agtaacttctgagtggagtgaggc

SEQ ID NO: 8758 - DNA, 23 bp, Artificial Sequence
  Synthetic nucleic acid molecule
agtaacttcaaaatgagtgaggc

SEQ ID NO: 8759 - DNA, 23 bp, Artificial Sequence
  Synthetic nucleic acid molecule
acctgcttcaaagtgagtgaggg

SEQ ID NO: 8760 - DNA, 24 bp, Artificial Sequence
  Synthetic nucleic acid molecule
agcattttccccctaaagtgagga

SEQ ID NO: 8761 - DNA, 24 bp, Artificial Sequence
  Synthetic nucleic acid molecule
agtaacttcagtatagagtgaggc

SEQ ID NO: 8762 - DNA, 23 bp, Artificial Sequence
  Synthetic nucleic acid molecule
agcaatgtttgagtgagtgatga

SEQ ID NO: 8763 - DNA, 23 bp, Artificial Sequence
  Synthetic nucleic acid molecule
agcattttcctttaaagtgagga

SEQ ID NO: 8764 - DNA, 24 bp, Artificial Sequence
  Synthetic nucleic acid molecule
agccacggctgcctggagtgaggg

SEQ ID NO: 8765 - DNA, 23 bp, Artificial Sequence
  Synthetic nucleic acid molecule
cctagagtccaggagagtgagga

SEQ ID NO: 8766 - DNA, 23 bp, Artificial Sequence
  Synthetic nucleic acid molecule
atcatagtgaccacgagtgaggc

SEQ ID NO: 8767 - DNA, 61 bp, Artificial Sequence
  Synthetic nucleic acid molecule
  misc_feature (8)..(51): n is a, c, g, or t
ccacgctnnnnnnnnnnnnnnnnnnnnnnnnnnnnnnnnnnnnnnnnnnnncctcgggact

SEQ ID NO: 8768 - DNA, 63 bp, Artificial Sequence
  Synthetic nucleic acid molecule
  misc_feature (8)..(53): n is a, c, g, or t
ccacgctnnnnnnnnnnnnnnnnnnnnnnnnnnnnnnnnnnnnnnnnnnnnnncctcgggact

SEQ ID NO: 8769 - DNA, 65 bp, Artificial Sequence
  Synthetic nucleic acid molecule
  misc_feature (8)..(55): n is a, c, g, or t
ccacgctnnnnnnnnnnnnnnnnnnnnnnnnnnnnnnnnnnnnnnnnnnnnnnnncctcgggact

SEQ ID NO: 8770 - DNA, 66 bp, Artificial Sequence
  Synthetic nucleic acid molecule
  misc_feature (8)..(56): n is a, c, g, or t
ccacgctnnnnnnnnnnnnnnnnnnnnnnnnnnnnnnnnnnnnnnnnnnnnnnnnncctcgggact

SEQ ID NO: 8771 - DNA, 67 bp, Artificial Sequence
  Synthetic nucleic acid molecule
  misc_feature (8)..(57): n is a, c, g, or t
ccacgctnnnnnnnnnnnnnnnnnnnnnnnnnnnnnnnnnnnnnnnnnnnnnnnnnncctcgggact

SEQ ID NO: 8772 - DNA, 68 bp, Artificial Sequence
  Synthetic nucleic acid molecule
  misc_feature (8)..(58): n is a, c, g, or t
ccacgctnnnnnnnnnnnnnnnnnnnnnnnnnnnnnnnnnnnnnnnnnnnnnnnnnnncctcgggact

SEQ ID NO: 8773 - DNA, 69 bp, Artificial Sequence
  Synthetic nucleic acid molecule
  misc_feature (8)..(59): n is a, c, g, or t
ccacgctnnnnnnnnnnnnnnnnnnnnnnnnnnnnnnnnnnnnnnnnnnnnnnnnnnnncctcgggact

SEQ ID NO: 8774 - DNA, 71 bp, Artificial Sequence
  Synthetic nucleic acid molecule
  misc_feature (8)..(61): n is a, c, g, or t
ccacgctnnnnnnnnnnnnnnnnnnnnnnnnnnnnnnnnnnnnnnnnnnnnnnnnnnnnnncctcgggact

SEQ ID NO: 8775 - DNA, 73 bp, Artificial Sequence
  Synthetic nucleic acid molecule
  misc_feature (8)..(63): n is a, c, g, or t
ccacgctnnnnnnnnnnnnnnnnnnnnnnnnnnnnnnnnnnnnnnnnnnnnnnnnnnnnnnnncctcgggact

SEQ ID NO: 8776 - DNA, 75 bp, Artificial Sequence
  Synthetic nucleic acid molecule
  misc_feature (8)..(65): n is a, c, g, or t
ccacgctnnnnnnnnnnnnnnnnnnnnnnnnnnnnnnnnnnnnnnnnnnnnnnnnnnnnnnnnnncctcgggact

What is claimed is:

1. A method comprising
   (a) providing a dimeric nuclease that cuts one or more double-stranded target sites of a double-stranded nucleic acid and creates a 5' overhang on the double-stranded nucleic acid, wherein the dimeric nuclease comprises two nuclease monomers, and wherein each of the target sites comprises
      (i) a left-half site, wherein the left-half site comprises a nucleic acid sequence that is bound by one monomer of the dimeric nuclease;
      (ii) a right-half site, wherein the right-half site comprises a nucleic acid sequence that is bound by other monomer of the dimeric nuclease; and
      (iii) a spacer sequence between the left-half site and the right-half site;
   wherein the left-half site, the spacer sequence, and right-half site forms a 5'-[the left-half site]-[the spacer sequence]-[the right-half site]-3' (LSR) structure, and the cleavage site of the dimeric nuclease is located within the spacer sequence;
   (b) contacting the dimeric nuclease with a library of candidate nucleic acid molecules, wherein each of the candidate nucleic acid molecules comprises a concatemer containing multiple copies of identical DNA sequences, a plurality of the target sites and multiple constant insert sequences, each of the constant insert sequences is located between two target sites of the plurality of the target sites, and each of the multiple copies of the identical DNA sequences comprises a target site of the plurality of the target sites and a constant insert sequence of the multiple constant insert sequences, under conditions suitable for the dimeric nuclease to cut a candidate nucleic acid molecule of the library of candidate nucleic acid molecules; thereby generating one or more candidate nucleic acid molecules cut once, twice and multiple times by the dimeric nuclease, wherein the candidate nucleic acid molecules cut twice by the dimeric nuclease comprise a 5' overhang and the constant insert sequence flanked by the left half-site and a part of the spacer sequence from one of the plurality of the target sites, and flanked by the right half-site and a part of the spacer sequence from another of the plurality of the target sites, (c) filling in the 5' overhang of each of the one or more candidate nucleic acid molecules cut twice by the dimeric nuclease, thereby creating one or more candidate nucleic acid molecules with blunt ends; and (d) identifying the one or more target sites of the one or more candidate nucleic acid molecules cut twice by the dimeric nuclease by determining the sequence of the one or more candidate nucleic acid molecules with blunt ends created in step (c).

2. The method of claim 1, wherein step (d) further comprises ligating sequencing adapters to the blunt ends of the one or more candidate nucleic acid molecules with blunt ends and amplifying and/or sequencing the one or more candidate nucleic acid molecules with blunt ends.

3. The method of claim 2, wherein said amplifying the one or more candidate nucleic acid molecules with blunt ends is performed via PCR after said ligating the sequencing adapters.

4. The method of claim 1, further comprises a step of enriching more than one of the candidate nucleic acid molecules with blunt ends.

5. The method of claim 4, wherein the step of enriching the more than one of the candidate nucleic acid molecules with blunt ends comprises a size fractionation of the more than one of the candidate nucleic acid molecules with blunt ends.

6. The method of claim 5, wherein the size fractionation is done by gel purification.

7. The method of claim 1, wherein the nuclease is a homing endonuclease.

8. The method of claim 1, further comprising compiling more than one of the target sites identified in step (d), thereby generating a nuclease target site profile.

9. The method of claim 1, wherein the nuclease is a therapeutic nuclease which cuts one or more specific nuclease target sites in a gene associated with a disease.

10. The method of claim 9 further comprising determining a maximum concentration of the therapeutic nuclease at which the therapeutic nuclease cuts the specific nuclease target sites, and does not cut more than 10 of the specific nuclease target sites in a genome.

11. The method of claim 9 further comprising determining a maximum concentration of the therapeutic nuclease at which the therapeutic nuclease cuts the specific nuclease target sites, and does not cut more than 5 of the specific target sites in a genome.

12. The method of claim 9 further comprising determining a maximum concentration of the therapeutic nuclease at which the therapeutic nuclease cuts the specific nuclease target sites, and does not cut more than 2 of the specific target sites in a genome.

13. The method of claim 9 further comprising determining a maximum concentration of the therapeutic nuclease at which the therapeutic nuclease cuts a specific nuclease target site of the specific nuclease target sites, and does not cut more than 1 of the specific target sites in a genome.

14. The method of claim 9 further comprising determining a maximum concentration of the therapeutic nuclease at which the therapeutic nuclease cuts a specific nuclease target site of the specific nuclease target sites, and does not cut any additional specific nuclease target site of the specific nuclease target sites in a genome.

15. The method of claim 1, wherein the nuclease comprises an unspecific nucleic acid cleavage domain.

16. The method of claim 1, wherein the nuclease comprises a FokI cleavage domain.

17. The method of claim 1, wherein the nuclease comprises a nucleic acid cleavage domain that cleaves a target sequence upon dimerization of the nucleic acid cleavage domain.

18. The method of claim 1, wherein the nuclease comprises a binding domain that specifically binds a nucleic acid sequence.

19. The method of claim 18, wherein the binding domain comprises a zinc finger.

20. The method of claim 19, wherein the binding domain comprises at least 2 zinc fingers.

21. The method of claim 19, wherein the binding domain comprises at least 3 zinc fingers.

22. The method of claim 19, wherein the binding domain comprises at least 4 zinc fingers.

23. The method of claim 19, wherein the binding domain comprises at least 5 zinc fingers.

24. The method of claim 18, wherein the binding domain comprises a Transcriptional Activator-Like Element.

25. The method of claim 1, wherein the nuclease is a Zinc Finger Nuclease.

26. The method of claim 1, wherein the nuclease is a Transcriptional Activator-Like Element Nuclease (TALEN).

* * * * *